US012599070B2

(12) United States Patent
Liu et al.

(10) Patent No.: US 12,599,070 B2
(45) Date of Patent: Apr. 14, 2026

(54) GENETIC LOCI ASSOCIATED WITH DISEASE RESISTANCE IN SOYBEANS

(71) Applicant: Syngenta Crop Protection AG, Basel (CH)

(72) Inventors: Qingli Liu, Durham, NC (US); Robert Arthur Dietrich, Durham, NC (US); Thomas Joseph Curley, Jr., Durham, NC (US); John Daniel Hipskind, Durham, NC (US); Becky Welsh Breitinger, Durham, NC (US); John Luther Dawson, Durham, NC (US)

(73) Assignee: SYNGENTA CROP PROTECTION AG, Basel (CH)

( * ) Notice: Subject to any disclaimer, the term of this patent is extended or adjusted under 35 U.S.C. 154(b) by 664 days.

(21) Appl. No.: 17/631,324

(22) PCT Filed: Jul. 31, 2020

(86) PCT No.: PCT/US2020/044367
§ 371 (c)(1),
(2) Date: Jan. 28, 2022

(87) PCT Pub. No.: WO2021/022101
PCT Pub. Date: Feb. 4, 2021

(65) Prior Publication Data
US 2022/0338433 A1     Oct. 27, 2022

Related U.S. Application Data

(60) Provisional application No. 62/881,035, filed on Jul. 31, 2019.

(51) Int. Cl.
*A01H 1/04* (2006.01)
*A01H 1/00* (2006.01)
(Continued)

(52) U.S. Cl.
CPC .......... *A01H 1/045* (2021.01); *A01H 1/1255* (2021.01); *A01H 6/542* (2018.05); *C12Q 1/6895* (2013.01);
(Continued)

(58) Field of Classification Search
None
See application file for complete search history.

(56) References Cited

U.S. PATENT DOCUMENTS 7,842,850 B2     11/2010  Singh
2004/0031072 A1   2/2004  La Rosa et al.
(Continued)

FOREIGN PATENT DOCUMENTS

WO      WO-2008153804 A2 *  12/2008  ............... A01H 1/02
WO      2017/222827      12/2017
WO      2019/103918      5/2019

OTHER PUBLICATIONS

Burdon & Speer ("A set of Differential Glycine Hosts for the Identification of Races of Phakopsora Pachyrhizi Syd." 1984 Euphytica 33:891-896). (Year: 1984).*
(Continued)

*Primary Examiner* — Matthew R Keogh
*Assistant Examiner* — Rebecca Stephens
(74) *Attorney, Agent, or Firm* — Suparna Kanjilal

(57) ABSTRACT

The present invention relates to methods and compositions for identifying, selecting and/or producing a Disease resistant soybean plant or germplasm using markers, genes and chromosomal intervals derived from *Glycine clandestina*, e.g. PI339656, or a progeny thereof. A soybean plant or germplasm that has been identified, selected and/or produced by any of the methods of the present invention is also
(Continued)

PI 339656 Chromosomal Mapping for SNPS Associated with ASR Resistance
Significantly Linked SNPs in Private Genome Mapped to Public Genome (Gmax_275_v2.0)[N=552 Markers]

Chr01  Chr03  Chr05  Chr07  Chr09  Chr11  Chr13  Chr15  Chr17  Chr19
Chr02  Chr04  Chr06  Chr08  Chr10  Chr12  Chr14  Chr16  Chr18  Chr20

[Broken line shows private SNPs b not scaffold 9588 mapped to single location; Solid line shows private SNPs from scaffold 14882 mapped to single location]

provided. Disease resistant soybean seeds, plants and germplasms are also provided.

3 Claims, 5 Drawing Sheets

Specification includes a Sequence Listing.

(51) Int. Cl.
*A01H 6/54* (2018.01)
*C12Q 1/6895* (2018.01)

(52) U.S. Cl.
CPC ... *C12Q 2600/13* (2013.01); *C12Q 2600/156* (2013.01)

(56) References Cited

U.S. PATENT DOCUMENTS

| | | | |
|---|---|---|---|
| 2013/0333061 A1 | 12/2013 | Wu et al. | |
| 2014/0255922 A1* | 9/2014 | Wu | C12Q 1/6895 |
| | | | 536/24.3 |
| 2015/0135359 A1* | 5/2015 | Baley | A01H 5/10 |
| | | | 800/267 |
| 2016/0272997 A1* | 9/2016 | Da Rosa | C12N 15/8271 |
| 2018/0103600 A1 | 4/2018 | Rairdan et al. | |
| 2022/0256795 A1* | 8/2022 | Liu | C12Q 1/6895 |
| 2022/0267789 A1* | 8/2022 | Liu | A01H 6/542 |

OTHER PUBLICATIONS

Hartman et al. ("Sources of Resistance to Soybean Rust in Perennial Glycine Species" 1992 Plant Disease 76(4): 396-399). (Year: 1992).*
Collard & Mackill ("Marker-assisted selection: an approach for precision plant breeding in the twenty-first century" Aug. 22, 2007 Phil. Trans. R. Soc. B 363:557-572 doi:10.1098/rstb.2007.2170; 16 total pages). (Year: 2007).*
Extended European Search Report for European U.S. Appl. No. 20/847,482 mailed Sep. 11, 2023, 9 total pages. (Year: 2023).*
International Preliminary Report on Patentability for International Application No. PCT/US2020/044367, mailed Feb. 10, 2022, 12 total pages. (Year: 2022).*
Written Opinion for International Application No. PCT/US2020/044367, mailed Feb. 15, 2021, 11 total pages. (Year: 2021).*
ISR for PCT/US2020/044367. Search dated Dec. 14, 2020.
Extended European Search Report for European Application No. 20847482.5, mailed Sep. 11, 2023, 9 Pages.
International Preliminary Report on Patentability for International Application No. PCT/US2020/044367, mailed Feb. 10, 2022, 13 Pages.
Written Opinion for International Application No. PCT/US2020/044367, mailed Jan. 22, 2021, 11 Pages.

* cited by examiner

FIG. 1: Screening of Wild Glycine Lines for Rust Resistance

FIG. 2: Rust Rating Scale

| | |
|---|---|
| RB0-NSP | No reaction to infection, or extremely small flecks/lesions |
| RB1-2-NSP | Necrotic or chlorotic flecks only, no sporulation |
| | Large or dense necrotic or chlorotic flecks only, no sporulation |
| RB3-NSP | minute uredia, large necrotic or chlorotic zones, few spores |
| RB4-SP | Small uredia with some associated necrotic or chlorotic tissues |
| TAN1-5-SP | large profusely sporelating uredia, little/no necrosis or chlorosis, 1-5 is the level of sporulations, density and severity |

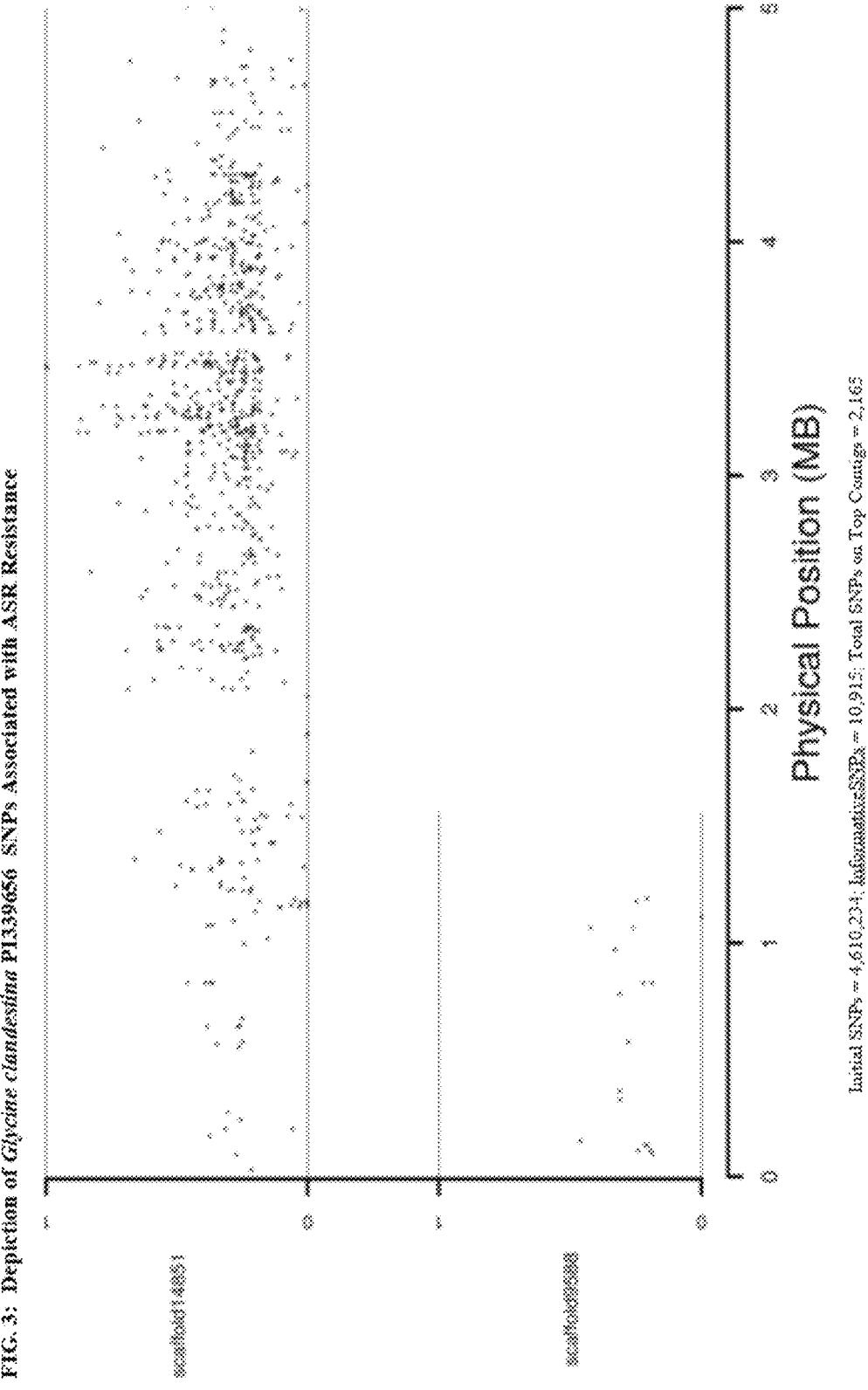
FIG. 3: Depiction of *Glycine clandestina* PI339656 SNPs Associated with ASR Resistance

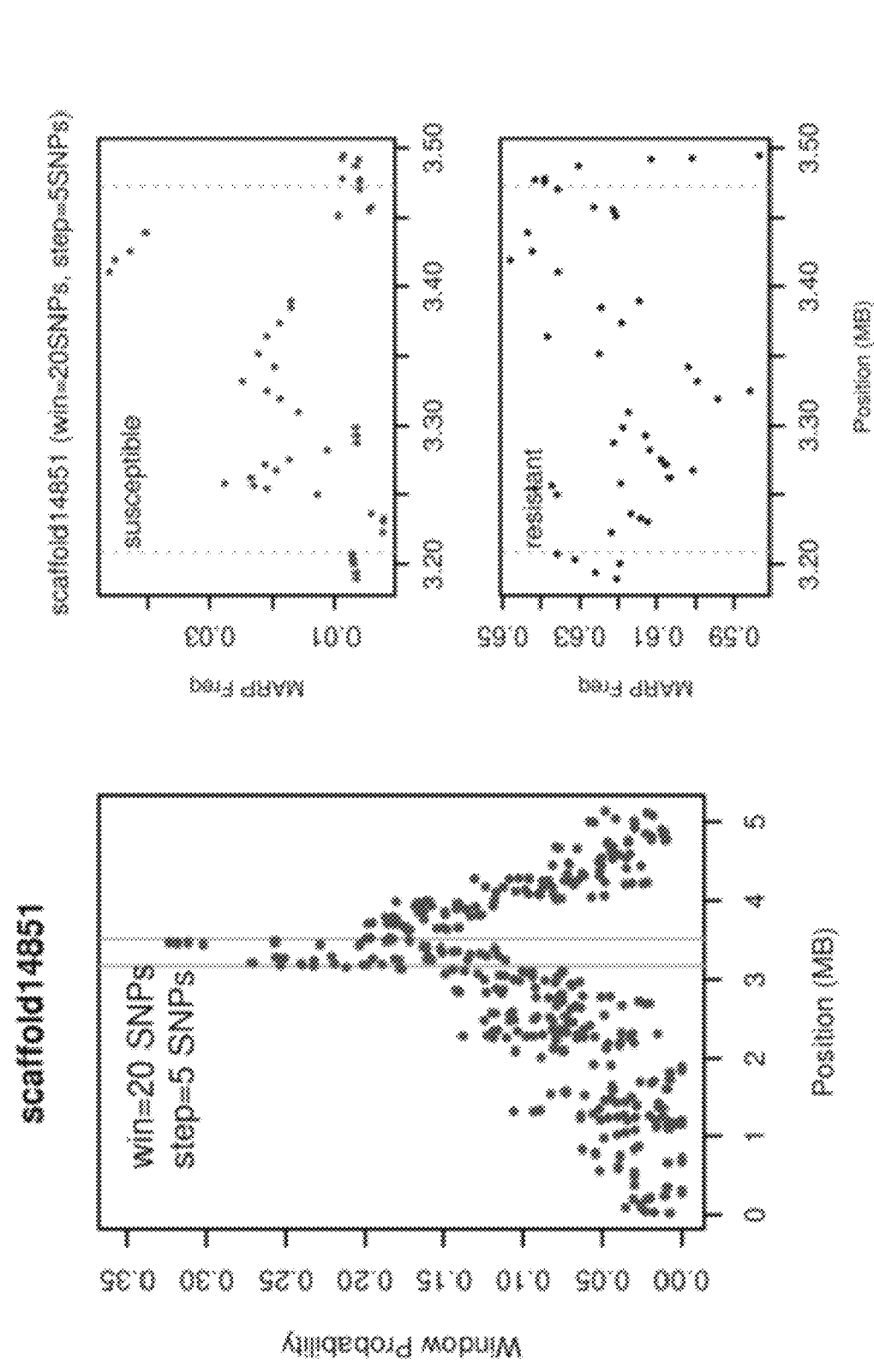
FIG. 4: Mapping Interval Discovery for Scaffold 14851 (Suggested Interval Chromosome 14: 3.18-3.5Mb)

Figure 5:
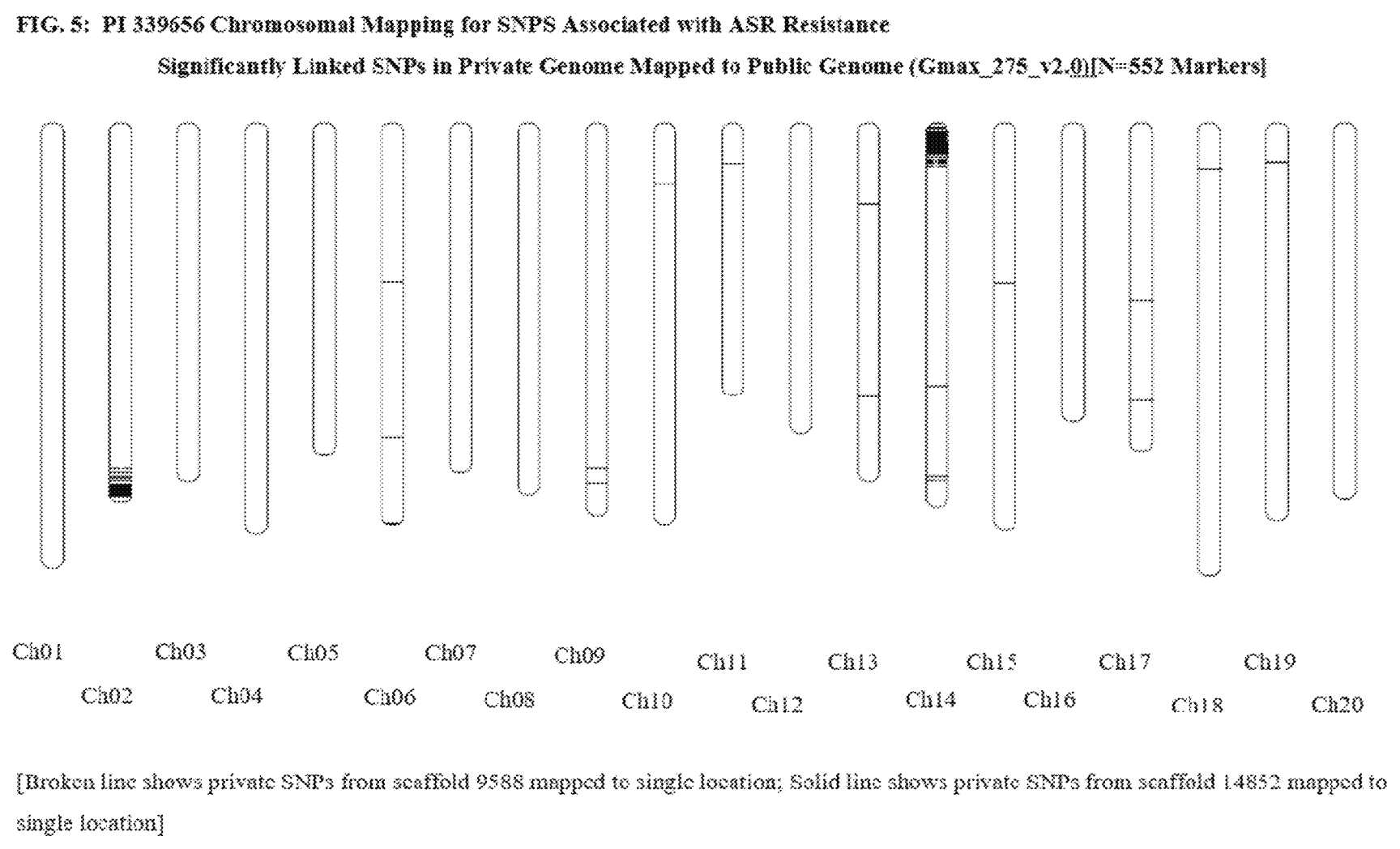

FIG. 5: PI 339656 Chromosomal Mapping for SNPS Associated with ASR Resistance

Significantly Linked SNPs in Private Genome Mapped to Public Genome (Gmax_275_v2.0)[N=552 Markers]

Ch01  Ch02  Ch03  Ch04  Ch05  Ch06  Ch07  Ch08  Ch09  Ch10  Ch11  Ch12  Ch13  Ch14  Ch15  Ch16  Ch17  Ch18  Ch19  Ch20

[Broken line shows private SNPs from scaffold 9588 mapped to single location; Solid line shows private SNPs from scaffold 14852 mapped to single location]

GENETIC LOCI ASSOCIATED WITH DISEASE RESISTANCE IN SOYBEANS

RELATED APPLICATION INFORMATION

This application is a 371 of International Application No. PCT/US2020/044367, filed 31 Jul. 2020, which claims priority to 62/881,035 filed 31 Jul. 2019, the contents of which are incorporated herein by reference herein.

FIELD OF THE INVENTION

The present invention relates to compositions and methods for identifying, selecting and producing enhanced disease and/or pathogen resistant soybean plants.

STATEMENT REGARDING ELECTRONIC SUBMISSION OF A SEQUENCE LISTING

A Sequence Listing in ASCII text format, submitted under 37 C.F.R. § 1.821, entitled "81923-US-REG-ORG-NAT-1_SeqList_ST25.txt", 6.44 MB (6,760,290 bytes) in size, generated on Jul. 31, 2019 and filed via EFS-Web is provided in lieu of a paper copy. This Sequence Listing is hereby incorporated by reference into the specification for its disclosures.

BACKGROUND

Plant pathogens are known to cause considerable damage to important crops, resulting in significant agricultural losses with widespread consequences for both the food supply and other industries that rely on plant materials. As such, there is a long felt need to reduce the incidence and/or impact of agricultural pathogens on crop production.

Several pathogens have been associated with damage to soybeans, which individually and collectively have the potential to cause significant yield losses in the United States and throughout the world. Exemplary pathogens include, but are not limited to fungi (e.g., genus *Phytophthora* and Asian Soybean rust *Phakopsora pahyrhizi*), nematodes (e.g., genus *Meloidogyne*, particularly, *Meloidogyne javanica*), and soybean stem canker. Given the significant threat to global food supplies that these pathogens present and the time and expense associated with treating soybean crops to prevent loss, new methods for producing pathogen resistant soybean cultivars are needed. What is needed is novel resistance genes (herein, "R-Genes") that can be introduced into commercial soybean plants to control soybean pathogens

SUMMARY OF THE INVENTION

This summary lists several embodiments of the presently disclosed subject matter, and in many cases lists variations of these embodiments.

Thus, it is an object of the presently disclosed subject matter to provide methods for conveying pathogen resistance into non-resistant soybean germplasm, which object is achieved in whole or in part by the presently disclosed subject matter.

BRIEF DESCRIPTION OF THE SEQUENCE LISTING

SEQ ID NO: 1 is a chromosomal intervals derived from *Glycine clandestina* line accession PI339656 referred to herein as "Scaffold 14851". Scaffold 14851 has been mapped to *G. clandestina* chromosome 14 at an approximate interval of 3.18 to 3.50 MB on Scaffold 14851. This chromosomal intervals or portions thereof may be introduced (i.e. introgressed through use of embryo rescue and/or marker assisted breeding (MAB) or transgenically into *Glycine max* lines to create *Glycine max* lines resistant to disease (e.g. Asian Soybean Rust (ASR)). In some embodiments, genes from this interval is expected to encode polypeptide(s) that may be transgenically expressed or genetically modified (i.e. gene edited via TALEN or CRISPR) in plants to confer disease resistance (e.g. Asian Soy Rust (ASR) resistance) Table 1 indicates single nucleotide polymorphisms (SNP) within SEQ ID NO: 1 that associate with ASR resistance. All alleles for the SNPs identified in Table 1 were determined to be significantly linked with resistance or susceptibility (p<0.05).

TABLE 1

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9101548 \| \| scaffold14851_3660_SNP | 3660 | T | C |
| S_9101624 \| \| scaffold14851_4916_SNP | 4916 | T | G |
| S_9101695 \| \| scaffold14851_5591_SNP | 5591 | T | A |
| S_9101714 \| \| scaffold14851_5936_SNP | 5936 | G | A |
| S_9101723 \| \| scaffold14851_5964_SNP | 5964 | C | T |
| S_9101793 \| \| scaffold14851_6357_SNP | 6357 | A | G |
| S_9101908 \| \| scaffold14851_8045_SNP | 8045 | C | T |
| S_9101915 \| \| scaffold14851_8146_SNP | 8146 | A | C |
| S_9101958 \| \| scaffold14851_8638_SNP | 8638 | A | G |
| S_9101965 \| \| scaffold14851_8849_SNP | 8849 | G | A |
| S_9101966 \| \| scaffold14851_8850_SNP | 8850 | A | T |
| S_9102048 \| \| scaffold14851_10133_SNP | 10133 | G | A |
| S_9102152 \| \| scaffold14851_10847_SNP | 10847 | G | A |
| S_9102195 \| \| scaffold14851_11463_SNP | 11463 | A | C |
| S_9102196 \| \| scaffold14851_11485_SNP | 11485 | G | C |
| S_9102198 \| \| scaffold14851_11518_SNP | 11518 | G | A |
| S_9102224 \| \| scaffold14851_11846_SNP | 11846 | A | T |
| S_9102229 \| \| scaffold14851_11956_SNP | 11956 | T | G |
| S_9102236 \| \| scaffold14851_12051_SNP | 12051 | T | A |
| S_9102250 \| \| scaffold14851_12194_SNP | 12194 | C | T |
| S_9102253 \| \| scaffold14851_12263_SNP | 12263 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9102254 \| \| scaffold14851_12273_SNP | 12273 | A | T |
| S_9102255 \| \| scaffold14851_12290_SNP | 12290 | T | A |
| S_9102478 \| \| scaffold14851_15258_SNP | 15258 | A | T |
| S_9102479 \| \| scaffold14851_15272_SNP | 15272 | C | T |
| S_9102492 \| \| scaffold14851_15462_SNP | 15462 | C | T |
| S_9102493 \| \| scaffold14851_15467_SNP | 15467 | C | T |
| S_9102497 \| \| scaffold14851_15499_SNP | 15499 | T | C |
| S_9102501 \| \| scaffold14851_15528_SNP | 15528 | C | T |
| S_9102596 \| \| scaffold14851_17027_SNP | 17027 | C | T |
| S_9102609 \| \| scaffold14851_17236_SNP | 17236 | T | A |
| S_9102700 \| \| scaffold14851_18500_SNP | 18500 | G | A |
| S_9102816 \| \| scaffold14851_19612_SNP | 19612 | G | C |
| S_9102831 \| \| scaffold14851_19897_SNP | 19897 | A | G |
| S_9102834 \| \| scaffold14851_19955_SNP | 19955 | T | C |
| S_9102835 \| \| scaffold14851_19973_SNP | 19973 | G | A |
| S_9102997 \| \| scaffold14851_21795_SNP | 21795 | A | G |
| S_9103003 \| \| scaffold14851_21853_SNP | 21853 | T | G |
| S_9103029 \| \| scaffold14851_22141_SNP | 22141 | T | C |
| S_9103088 \| \| scaffold14851_22602_SNP | 22602 | A | G |
| S_9103094 \| \| scaffold14851_22690_SNP | 22690 | A | G |
| S_9103098 \| \| scaffold14851_22765_SNP | 22765 | C | T |
| S_9103101 \| \| scaffold14851_22792_SNP | 22792 | T | A |
| S_9103103 \| \| scaffold14851_22802_SNP | 22802 | T | C |
| S_9103106 \| \| scaffold14851_22856_SNP | 22856 | G | A |
| S_9103125 \| \| scaffold14851_23000_SNP | 23000 | T | G |
| S_9103131 \| \| scaffold14851_23028_SNP | 23028 | C | A |
| S_9103132 \| \| scaffold14851_23034_SNP | 23034 | C | T |
| S_9103183 \| \| scaffold14851_23790_SNP | 23790 | A | T |
| S_9103185 \| \| scaffold14851_23822_SNP | 23822 | A | G |
| S_9103311 \| \| scaffold14851_25521_SNP | 25521 | G | T |
| S_9103336 \| \| scaffold14851_26070_SNP | 26070 | A | C |
| S_9103360 \| \| scaffold14851_26409_SNP | 26409 | T | C |
| S_9103394 \| \| scaffold14851_26715_SNP | 26715 | T | C |
| S_9103395 \| \| scaffold14851_26722_SNP | 26722 | G | T |
| S_9103405 \| \| scaffold14851_26886_SNP | 26886 | G | T |
| S_9103428 \| \| scaffold14851_27158_SNP | 27158 | T | A |
| S_9103449 \| \| scaffold14851_27369_SNP | 27369 | C | T |
| S_9103545 \| \| scaffold14851_28688_SNP | 28688 | T | C |
| S_9103547 \| \| scaffold14851_28693_SNP | 28693 | C | G |
| S_9103572 \| \| scaffold14851_29075_SNP | 29075 | T | G |
| S_9103573 \| \| scaffold14851_29095_SNP | 29095 | G | A |
| S_9103711 \| \| scaffold14851_31375_SNP | 31375 | T | C |
| S_9103717 \| \| scaffold14851_31522_SNP | 31522 | C | T |
| S_9103727 \| \| scaffold14851_31712_SNP | 31712 | C | G |
| S_9103910 \| \| scaffold14851_33901_SNP | 33901 | T | C |
| S_9103930 \| \| scaffold14851_34159_SNP | 34159 | G | A |
| S_9103975 \| \| scaffold14851_34788_SNP | 34788 | G | A |
| S_9104008 \| \| scaffold14851_35433_SNP | 35433 | G | T |
| S_9104009 \| \| scaffold14851_35447_SNP | 35447 | G | C |
| S_9104027 \| \| scaffold14851_35728_SNP | 35728 | A | G |
| S_9104028 \| \| scaffold14851_35732_SNP | 35732 | A | G |
| S_9104054 \| \| scaffold14851_36288_SNP | 36288 | T | A |
| S_9104093 \| \| scaffold14851_36783_SNP | 36783 | G | T |
| S_9104106 \| \| scaffold14851_37111_SNP | 37111 | A | G |
| S_9104487 \| \| scaffold14851_41584_SNP | 41584 | T | C |
| S_9104715 \| \| scaffold14851_44891_SNP | 44891 | A | T |
| S_9104748 \| \| scaffold14851_45503_SNP | 45503 | T | G |
| S_9104975 \| \| scaffold14851_48280_SNP | 48280 | A | C |
| S_9104996 \| \| scaffold14851_48646_SNP | 48646 | T | G |
| S_9105000 \| \| scaffold14851_48759_SNP | 48759 | C | A |
| S_9105220 \| \| scaffold14851_51087_SNP | 51087 | C | T |
| S_9105230 \| \| scaffold14851_51159_SNP | 51159 | T | G |
| scaffold14851_51786_SNP | 51786 | A | G |
| S_9105282 \| \| scaffold14851_51816_SNP | 51816 | A | G |
| S_9105380 \| \| scaffold14851_53311_SNP | 53311 | C | G |
| S_9105385 \| \| scaffold14851_53387_SNP | 53387 | G | C |
| S_9105393 \| \| scaffold14851_53494_SNP | 53494 | G | T |
| S_9105420 \| \| scaffold14851_53829_SNP | 53829 | T | C |
| S_9105818 \| \| scaffold14851_59533_SNP | 59533 | A | C |
| S_9105830 \| \| scaffold14851_59807_SNP | 59807 | T | C |
| S_9105831 \| \| scaffold14851_59808_SNP | 59808 | G | A |
| S_9105866 \| \| scaffold14851_60355_SNP | 60355 | G | A |
| S_9105886 \| \| scaffold14851_60673_SNP | 60673 | T | C |
| S_9105999 \| \| scaffold14851_61299_SNP | 61299 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9106000 \| \| scaffold14851_61300_SNP | 61300 | C | G |
| S_9106002 \| \| scaffold14851_61341_SNP | 61341 | T | C |
| S_9106010 \| \| scaffold14851_61461_SNP | 61461 | G | T |
| S_9106105 \| \| scaffold14851_62776_SNP | 62776 | T | G |
| S_9106128 \| \| scaffold14851_62877_SNP | 62877 | G | A |
| S_9106131 \| \| scaffold14851_62911_SNP | 62911 | T | G |
| S_9106136 \| \| scaffold14851_62934_SNP | 62934 | G | T |
| S_9106220 \| \| scaffold14851_64304_SNP | 64304 | A | G |
| S_9106235 \| \| scaffold14851_64510_SNP | 64510 | C | G |
| S_9106340 \| \| scaffold14851_65613_SNP | 65613 | C | T |
| S_9106377 \| \| scaffold14851_66281_SNP | 66281 | C | A |
| S_9106383 \| \| scaffold14851_66359_SNP | 66359 | A | C |
| S_9106409 \| \| scaffold14851_66622_SNP | 66622 | T | G |
| S_9106418 \| \| scaffold14851_66702_SNP | 66702 | A | G |
| S_9106471 \| \| scaffold14851_67357_SNP | 67357 | T | G |
| S_9106646 \| \| scaffold14851_69492_SNP | 69492 | A | G |
| S_9106654 \| \| scaffold14851_69598_SNP | 69598 | A | G |
| S_9106684 \| \| scaffold14851_70118_SNP | 70118 | T | A |
| S_9106693 \| \| scaffold14851_70213_SNP | 70213 | G | C |
| S_9106740 \| \| scaffold14851_70796_SNP | 70796 | A | G |
| S_9106938 \| \| scaffold14851_73249_SNP | 73249 | T | C |
| S_9106979 \| \| scaffold14851_73945_SNP | 73945 | A | T |
| S_9106983 \| \| scaffold14851_73975_SNP | 73975 | T | A |
| S_9106995 \| \| scaffold14851_74161_SNP | 74161 | T | A |
| S_9107002 \| \| scaffold14851_74325_SNP | 74325 | G | A |
| S_9107050 \| \| scaffold14851_75069_SNP | 75069 | G | A |
| S_9107106 \| \| scaffold14851_75877_SNP | 75877 | A | C |
| S_9107243 \| \| scaffold14851_77407_SNP | 77407 | A | T |
| S_9107277 \| \| scaffold14851_77779_SNP | 77779 | G | T |
| S_9107288 \| \| scaffold14851_77993_SNP | 77993 | G | A |
| S_9107312 \| \| scaffold14851_78103_SNP | 78103 | T | A |
| S_9107339 \| \| scaffold14851_78607_SNP | 78607 | T | A |
| S_9107372 \| \| scaffold14851_79277_SNP | 79277 | C | T |
| S_9107374 \| \| scaffold14851_79283_SNP | 79283 | G | A |
| S_9107382 \| \| scaffold14851_79421_SNP | 79421 | A | T |
| S_9107383 \| \| scaffold14851_79429_SNP | 79429 | A | G |
| S_9107421 \| \| scaffold14851_79800_SNP | 79800 | A | G |
| S_9107437 \| \| scaffold14851_80132_SNP | 80132 | C | T |
| S_9107453 \| \| scaffold14851_80396_SNP | 80396 | T | C |
| S_9107472 \| \| scaffold14851_80592_SNP | 80592 | A | G |
| S_9107521 \| \| scaffold14851_81046_SNP | 81046 | A | C |
| S_9107838 \| \| scaffold14851_84321_SNP | 84321 | C | T |
| S_9107840 \| \| scaffold14851_84337_SNP | 84337 | A | G |
| S_9107853 \| \| scaffold14851_84464_SNP | 84464 | A | G |
| S_9107856 \| \| scaffold14851_84480_SNP | 84480 | C | T |
| S_9107869 \| \| scaffold14851_84637_SNP | 84637 | G | A |
| S_9107870 \| \| scaffold14851_84640_SNP | 84640 | C | T |
| S_9107871 \| \| scaffold14851_84643_SNP | 84643 | C | T |
| S_9108036 \| \| scaffold14851_85719_SNP | 85719 | G | A |
| S_9108093 \| \| scaffold14851_86230_SNP | 86230 | T | C |
| S_9108129 \| \| scaffold14851_86746_SNP | 86746 | G | A |
| S_9108147 \| \| scaffold14851_87098_SNP | 87098 | G | A |
| S_9108210 \| \| scaffold14851_88001_SNP | 88001 | C | G |
| S_9108215 \| \| scaffold14851_88078_SNP | 88078 | C | A |
| S_9108254 \| \| scaffold14851_88580_SNP | 88580 | G | A |
| S_9108258 \| \| scaffold14851_88616_SNP | 88616 | A | T |
| S_9108374 \| \| scaffold14851_89544_SNP | 89544 | G | A |
| S_9108379 \| \| scaffold14851_89630_SNP | 89630 | T | G |
| S_9108393 \| \| scaffold14851_89771_SNP | 89771 | A | T |
| S_9108397 \| \| scaffold14851_89805_SNP | 89805 | A | T |
| S_9108489 \| \| scaffold14851_90808_SNP | 90808 | C | A |
| S_9108510 \| \| scaffold14851_91042_SNP | 91042 | C | A |
| S_9108552 \| \| scaffold14851_91634_SNP | 91634 | C | T |
| S_9108553 \| \| scaffold14851_91635_SNP | 91635 | C | T |
| S_9108561 \| \| scaffold14851_91811_SNP | 91811 | A | G |
| S_9108599 \| \| scaffold14851_92509_SNP | 92509 | A | G |
| S_9108600 \| \| scaffold14851_92510_SNP | 92510 | T | A |
| S_9108639 \| \| scaffold14851_92972_SNP | 92972 | C | G |
| S_9108663 \| \| scaffold14851_93254_SNP | 93254 | A | C |
| S_9108665 \| \| scaffold14851_93287_SNP | 93287 | T | A |
| S_9108667 \| \| scaffold14851_93302_SNP | 93302 | G | A |
| S_9108672 \| \| scaffold14851_93347_SNP | 93347 | G | A |
| S_9108840 \| \| scaffold14851_95114_SNP | 95114 | C | A |
| S_9108843 \| \| scaffold14851_95144_SNP | 95144 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9108844 \| \| scaffold14851_95167_SNP | 95167 | A | G |
| S_9108962 \| \| scaffold14851_96063_SNP | 96063 | G | A |
| S_9108965 \| \| scaffold14851_96162_SNP | 96162 | G | T |
| S_9108967 \| \| scaffold14851_96254_SNP | 96254 | A | T |
| S_9109058 \| \| scaffold14851_97640_SNP | 97640 | G | A |
| S_9109076 \| \| scaffold14851_97887_SNP | 97887 | C | T |
| S_9109093 \| \| scaffold14851_98078_SNP | 98078 | T | G |
| S_9109224 \| \| scaffold14851_101273_SNP | 101273 | G | T |
| S_9109387 \| \| scaffold14851_105359_SNP | 105359 | C | T |
| S_9109457 \| \| scaffold14851_106071_SNP | 106071 | A | G |
| S_9109822 \| \| scaffold14851_109392_SNP | 109392 | A | G |
| S_9109994 \| \| scaffold14851_111503_SNP | 111503 | G | A |
| S_9110003 \| \| scaffold14851_111729_SNP | 111729 | T | C |
| S_9110021 \| \| scaffold14851_112028_SNP | 112028 | T | A |
| S_9110123 \| \| scaffold14851_113183_SNP | 113183 | C | T |
| S_9110124 \| \| scaffold14851_113185_SNP | 113185 | A | T |
| S_9110154 \| \| scaffold14851_113720_SNP | 113720 | T | C |
| S_9110202 \| \| scaffold14851_114457_SNP | 114457 | G | A |
| S_9110226 \| \| scaffold14851_115063_SNP | 115063 | A | G |
| S_9110231 \| \| scaffold14851_115097_SNP | 115097 | G | A |
| S_9110234 \| \| scaffold14851_115132_SNP | 115132 | T | A |
| S_9110261 \| \| scaffold14851_115414_SNP | 115414 | G | T |
| S_9110267 \| \| scaffold14851_115440_SNP | 115440 | G | T |
| S_9110329 \| \| scaffold14851_115865_SNP | 115865 | T | C |
| S_9110330 \| \| scaffold14851_115907_SNP | 115907 | A | C |
| S_9110331 \| \| scaffold14851_115910_SNP | 115910 | T | A |
| S_9110348 \| \| scaffold14851_116144_SNP | 116144 | C | A |
| S_9110359 \| \| scaffold14851_116271_SNP | 116271 | G | C |
| S_9110398 \| \| scaffold14851_116676_SNP | 116676 | G | T |
| S_9110550 \| \| scaffold14851_118844_SNP | 118844 | G | A |
| S_9110593 \| \| scaffold14851_119667_SNP | 119667 | A | G |
| S_9110619 \| \| scaffold14851_119964_SNP | 119964 | C | A |
| S_9110671 \| \| scaffold14851_120680_SNP | 120680 | C | G |
| S_9110682 \| \| scaffold14851_120850_SNP | 120850 | T | C |
| S_9110695 \| \| scaffold14851_121031_SNP | 121031 | A | C |
| S_9110703 \| \| scaffold14851_121204_SNP | 121204 | T | C |
| S_9110720 \| \| scaffold14851_121633_SNP | 121633 | C | A |
| S_9110724 \| \| scaffold14851_121650_SNP | 121650 | G | A |
| S_9110929 \| \| scaffold14851_123608_SNP | 123608 | A | T |
| S_9110958 \| \| scaffold14851_123851_SNP | 123851 | A | G |
| scaffold14851_124068_SNP | 124068 | A | G |
| S_9111236 \| \| scaffold14851_124759_SNP | 124759 | C | T |
| S_9111609 \| \| scaffold14851_128383_SNP | 128383 | A | T |
| S_9111617 \| \| scaffold14851_128692_SNP | 128692 | G | A |
| S_9111641 \| \| scaffold14851_128920_SNP | 128920 | C | T |
| S_9111643 \| \| scaffold14851_128926_SNP | 128926 | G | A |
| S_9111658 \| \| scaffold14851_128969_SNP | 128969 | G | A |
| S_9111727 \| \| scaffold14851_129913_SNP | 129913 | T | A |
| S_9111856 \| \| scaffold14851_132830_SNP | 132830 | A | G |
| S_9111889 \| \| scaffold14851_133233_SNP | 133233 | A | G |
| S_9111890 \| \| scaffold14851_133248_SNP | 133248 | C | T |
| S_9111892 \| \| scaffold14851_133284_SNP | 133284 | T | A |
| S_9111933 \| \| scaffold14851_133957_SNP | 133957 | T | C |
| S_9111936 \| \| scaffold14851_133986_SNP | 133986 | T | C |
| S_9111987 \| \| scaffold14851_134471_SNP | 134471 | A | G |
| scaffold14851_136653_SNP | 136653 | T | C |
| scaffold14851_136700_SNP | 136700 | A | G |
| S_9112204 \| \| scaffold14851_136749_SNP | 136749 | G | A |
| S_9112206 \| \| scaffold14851_136762_SNP | 136762 | A | C |
| S_9112208 \| \| scaffold14851_136776_SNP | 136776 | T | C |
| S_9112210 \| \| scaffold14851_136792_SNP | 136792 | T | C |
| S_9112240 \| \| scaffold14851_137009_SNP | 137009 | A | C |
| S_9112270 \| \| scaffold14851_137334_SNP | 137334 | G | T |
| S_9112277 \| \| scaffold14851_137454_SNP | 137454 | T | C |
| S_9112278 \| \| scaffold14851_137458_SNP | 137458 | G | A |
| scaffold14851_137644_SNP | 137644 | T | C |
| scaffold14851_138141_SNP | 138141 | A | C |
| scaffold14851_138144_SNP | 138144 | C | T |
| S_9112986 \| \| scaffold14851_141031_SNP | 141031 | A | G |
| S_9112996 \| \| scaffold14851_141167_SNP | 141167 | T | A |
| S_9113228 \| \| scaffold14851_143952_SNP | 143952 | G | A |
| S_9113290 \| \| scaffold14851_144707_SNP | 144707 | T | G |
| S_9113405 \| \| scaffold14851_146060_SNP | 146060 | G | A |
| S_9113412 \| \| scaffold14851_146167_SNP | 146167 | T | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9113570 \| \| scaffold14851_148538_SNP | 148538 | T | G |
| S_9113582 \| \| scaffold14851_148731_SNP | 148731 | C | T |
| S_9113728 \| \| scaffold14851_150853_SNP | 150853 | G | A |
| S_9113949 \| \| scaffold14851_154714_SNP | 154714 | A | G |
| scaffold14851_158439_SNP | 158439 | A | G |
| S_9114145 \| \| scaffold14851_158445_SNP | 158445 | A | T |
| S_9114151 \| \| scaffold14851_158710_SNP | 158710 | A | T |
| S_9114154 \| \| scaffold14851_158743_SNP | 158743 | A | G |
| S_9114159 \| \| scaffold14851_158830_SNP | 158830 | G | A |
| S_9114165 \| \| scaffold14851_158944_SNP | 158944 | T | G |
| S_9114167 \| \| scaffold14851_158957_SNP | 158957 | C | G |
| S_9114260 \| \| scaffold14851_159409_SNP | 159409 | C | T |
| S_9114432 \| \| scaffold14851_161394_SNP | 161394 | G | A |
| S_9114588 \| \| scaffold14851_163173_SNP | 163173 | G | A |
| S_9114613 \| \| scaffold14851_163471_SNP | 163471 | G | A |
| S_9114916 \| \| scaffold14851_167422_SNP | 167422 | G | A |
| S_9114929 \| \| scaffold14851_167617_SNP | 167617 | A | G |
| S_9115007 \| \| scaffold14851_167860_SNP | 167860 | G | A |
| S_9115010 \| \| scaffold14851_167877_SNP | 167877 | T | A |
| S_9115084 \| \| scaffold14851_168709_SNP | 168709 | C | T |
| S_9115172 \| \| scaffold14851_169754_SNP | 169754 | T | G |
| S_9115202 \| \| scaffold14851_170006_SNP | 170006 | C | T |
| S_9115210 \| \| scaffold14851_170164_SNP | 170164 | A | C |
| S_9115227 \| \| scaffold14851_170478_SNP | 170478 | T | A |
| S_9115235 \| \| scaffold14851_170618_SNP | 170618 | T | G |
| S_9115236 \| \| scaffold14851_170654_SNP | 170654 | C | T |
| S_9115241 \| \| scaffold14851_170752_SNP | 170752 | T | C |
| S_9115243 \| \| scaffold14851_170793_SNP | 170793 | A | G |
| S_9115246 \| \| scaffold14851_170846_SNP | 170846 | G | A |
| S_9115250 \| \| scaffold14851_170931_SNP | 170931 | T | C |
| S_9115252 \| \| scaffold14851_170977_SNP | 170977 | T | C |
| S_9115472 \| \| scaffold14851_171642_SNP | 171642 | G | A |
| S_9115490 \| \| scaffold14851_171927_SNP | 171927 | C | T |
| S_9115491 \| \| scaffold14851_171933_SNP | 171933 | G | A |
| S_9115571 \| \| scaffold14851_173349_SNP | 173349 | T | A |
| S_9115626 \| \| scaffold14851_174121_SNP | 174121 | T | A |
| S_9115732 \| \| scaffold14851_175869_SNP | 175869 | C | A |
| S_9115749 \| \| scaffold14851_176118_SNP | 176118 | A | G |
| S_9115750 \| \| scaffold14851_176133_SNP | 176133 | C | G |
| S_9115760 \| \| scaffold14851_176229_SNP | 176229 | T | A |
| S_9115826 \| \| scaffold14851_177472_SNP | 177472 | C | A |
| S_9115832 \| \| scaffold14851_177537_SNP | 177537 | T | C |
| S_9115855 \| \| scaffold14851_177941_SNP | 177941 | C | T |
| S_9115863 \| \| scaffold14851_178119_SNP | 178119 | A | G |
| S_9115868 \| \| scaffold14851_178207_SNP | 178207 | A | T |
| S_9115885 \| \| scaffold14851_178522_SNP | 178522 | A | G |
| S_9115887 \| \| scaffold14851_178551_SNP | 178551 | C | T |
| S_9115938 \| \| scaffold14851_179498_SNP | 179498 | C | T |
| S_9115941 \| \| scaffold14851_179552_SNP | 179552 | T | G |
| S_9116111 \| \| scaffold14851_181340_SNP | 181340 | A | G |
| S_9116126 \| \| scaffold14851_181587_SNP | 181587 | T | C |
| S_9116245 \| \| scaffold14851_182434_SNP | 182434 | A | C |
| S_9116252 \| \| scaffold14851_182461_SNP | 182461 | T | G |
| S_9116260 \| \| scaffold14851_182599_SNP | 182599 | G | C |
| S_9116278 \| \| scaffold14851_182916_SNP | 182916 | G | A |
| S_9116299 \| \| scaffold14851_183113_SNP | 183113 | G | A |
| S_9116326 \| \| scaffold14851_183533_SNP | 183533 | T | C |
| S_9116330 \| \| scaffold14851_183590_SNP | 183590 | T | A |
| S_9116464 \| \| scaffold14851_185878_SNP | 185878 | C | A |
| S_9116468 \| \| scaffold14851_185938_SNP | 185938 | G | A |
| S_9116476 \| \| scaffold14851_186146_SNP | 186146 | C | T |
| S_9116477 \| \| scaffold14851_186158_SNP | 186158 | T | G |
| S_9116666 \| \| scaffold14851_188346_SNP | 188346 | A | G |
| S_9116711 \| \| scaffold14851_189085_SNP | 189085 | A | T |
| S_9116939 \| \| scaffold14851_192255_SNP | 192255 | G | A |
| S_9117225 \| \| scaffold14851_195663_SNP | 195663 | A | C |
| S_9117227 \| \| scaffold14851_195715_SNP | 195715 | G | C |
| S_9117256 \| \| scaffold14851_196171_SNP | 196171 | G | A |
| S_9117271 \| \| scaffold14851_196318_SNP | 196318 | A | C |
| S_9117357 \| \| scaffold14851_197099_SNP | 197099 | A | T |
| S_9117358 \| \| scaffold14851_197112_SNP | 197112 | G | T |
| S_9117373 \| \| scaffold14851_197370_SNP | 197370 | A | C |
| S_9117377 \| \| scaffold14851_197427_SNP | 197427 | T | G |
| S_9117397 \| \| scaffold14851_197799_SNP | 197799 | C | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9117423 \| \| scaffold14851_198177_SNP | 198177 | A | T |
| S_9117437 \| \| scaffold14851_198536_SNP | 198536 | G | A |
| S_9117483 \| \| scaffold14851_199218_SNP | 199218 | A | G |
| S_9117499 \| \| scaffold14851_199524_SNP | 199524 | T | C |
| S_9117501 \| \| scaffold14851_199549_SNP | 199549 | A | G |
| S_9117509 \| \| scaffold14851_199777_SNP | 199777 | A | G |
| S_9117599 \| \| scaffold14851_201986_SNP | 201986 | G | T |
| S_9117601 \| \| scaffold14851_201993_SNP | 201993 | A | T |
| S_9117603 \| \| scaffold14851_202011_SNP | 202011 | A | T |
| S_9117605 \| \| scaffold14851_202042_SNP | 202042 | T | A |
| S_9117606 \| \| scaffold14851_202059_SNP | 202059 | C | A |
| S_9117655 \| \| scaffold14851_202742_SNP | 202742 | A | C |
| S_9117725 \| \| scaffold14851_203819_SNP | 203819 | T | C |
| S_9117789 \| \| scaffold14851_204813_SNP | 204813 | T | C |
| S_9118058 \| \| scaffold14851_207263_SNP | 207263 | C | A |
| S_9118065 \| \| scaffold14851_207405_SNP | 207405 | C | G |
| S_9118100 \| \| scaffold14851_207828_SNP | 207828 | A | T |
| S_9118120 \| \| scaffold14851_208111_SNP | 208111 | C | T |
| S_9118139 \| \| scaffold14851_208348_SNP | 208348 | T | A |
| S_9118141 \| \| scaffold14851_208380_SNP | 208380 | T | A |
| S_9118165 \| \| scaffold14851_208619_SNP | 208619 | C | T |
| S_9118248 \| \| scaffold14851_209819_SNP | 209819 | A | G |
| S_9118251 \| \| scaffold14851_209847_SNP | 209847 | C | T |
| S_9118403 \| \| scaffold14851_211195_SNP | 211195 | G | A |
| S_9118452 \| \| scaffold14851_212035_SNP | 212035 | G | A |
| S_9118453 \| \| scaffold14851_212042_SNP | 212042 | G | C |
| S_9118465 \| \| scaffold14851_212161_SNP | 212161 | A | T |
| S_9118497 \| \| scaffold14851_212821_SNP | 212821 | A | C |
| S_9118506 \| \| scaffold14851_212911_SNP | 212911 | A | T |
| S_9118514 \| \| scaffold14851_213081_SNP | 213081 | A | C |
| S_9118515 \| \| scaffold14851_213130_SNP | 213130 | A | G |
| S_9118525 \| \| scaffold14851_213266_SNP | 213266 | C | A |
| S_9118620 \| \| scaffold14851_214897_SNP | 214897 | T | C |
| S_9118624 \| \| scaffold14851_214943_SNP | 214943 | C | T |
| S_9118672 \| \| scaffold14851_215692_SNP | 215692 | C | T |
| S_9118674 \| \| scaffold14851_215698_SNP | 215698 | C | A |
| S_9118700 \| \| scaffold14851_216037_SNP | 216037 | C | T |
| S_9118707 \| \| scaffold14851_216120_SNP | 216120 | T | C |
| S_9118768 \| \| scaffold14851_217077_SNP | 217077 | C | T |
| S_9118769 \| \| scaffold14851_217089_SNP | 217089 | G | C |
| S_9118780 \| \| scaffold14851_217300_SNP | 217300 | A | G |
| S_9118782 \| \| scaffold14851_217314_SNP | 217314 | G | C |
| S_9118784 \| \| scaffold14851_217347_SNP | 217347 | A | G |
| S_9118814 \| \| scaffold14851_217789_SNP | 217789 | T | A |
| S_9118861 \| \| scaffold14851_218824_SNP | 218824 | T | A |
| S_9118902 \| \| scaffold14851_219798_SNP | 219798 | G | T |
| S_9118903 \| \| scaffold14851_219807_SNP | 219807 | G | T |
| S_9119052 \| \| scaffold14851_220953_SNP | 220953 | T | C |
| S_9119065 \| \| scaffold14851_221188_SNP | 221188 | C | T |
| S_9119098 \| \| scaffold14851_221607_SNP | 221607 | A | T |
| S_9119196 \| \| scaffold14851_222838_SNP | 222838 | A | C |
| S_9119229 \| \| scaffold14851_223550_SNP | 223550 | T | C |
| S_9119231 \| \| scaffold14851_223561_SNP | 223561 | A | G |
| S_9119232 \| \| scaffold14851_223576_SNP | 223576 | G | A |
| S_9119293 \| \| scaffold14851_224502_SNP | 224502 | T | G |
| S_9119312 \| \| scaffold14851_224873_SNP | 224873 | C | T |
| S_9119345 \| \| scaffold14851_225572_SNP | 225572 | T | C |
| S_9119484 \| \| scaffold14851_227137_SNP | 227137 | G | A |
| S_9119664 \| \| scaffold14851_229315_SNP | 229315 | T | C |
| S_9119679 \| \| scaffold14851_229491_SNP | 229491 | G | A |
| S_9119680 \| \| scaffold14851_229592_SNP | 229592 | G | A |
| S_9120065 \| \| scaffold14851_234463_SNP | 234463 | C | A |
| S_9120075 \| \| scaffold14851_234596_SNP | 234596 | A | G |
| S_9120129 \| \| scaffold14851_235664_SNP | 235664 | A | C |
| S_9120130 \| \| scaffold14851_235682_SNP | 235682 | A | T |
| S_9120134 \| \| scaffold14851_235800_SNP | 235800 | T | A |
| S_9120135 \| \| scaffold14851_235802_SNP | 235802 | G | A |
| S_9120138 \| \| scaffold14851_235947_SNP | 235947 | C | T |
| S_9120145 \| \| scaffold14851_236009_SNP | 236009 | C | T |
| S_9120273 \| \| scaffold14851_237748_SNP | 237748 | C | T |
| S_9120276 \| \| scaffold14851_237771_SNP | 237771 | C | G |
| S_9120359 \| \| scaffold14851_239260_SNP | 239260 | A | G |
| S_9120374 \| \| scaffold14851_239503_SNP | 239503 | C | G |
| S_9120376 \| \| scaffold14851_239529_SNP | 239529 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9120377 \| \| scaffold14851_239552_SNP | 239552 | G | A |
| S_9120455 \| \| scaffold14851_240480_SNP | 240480 | G | T |
| S_9120459 \| \| scaffold14851_240526_SNP | 240526 | C | T |
| S_9120464 \| \| scaffold14851_240574_SNP | 240574 | A | G |
| S_9120466 \| \| scaffold14851_240582_SNP | 240582 | C | A |
| S_9120468 \| \| scaffold14851_240600_SNP | 240600 | G | A |
| S_9120495 \| \| scaffold14851_240827_SNP | 240827 | A | G |
| S_9120497 \| \| scaffold14851_240855_SNP | 240855 | C | G |
| S_9120501 \| \| scaffold14851_240906_SNP | 240906 | C | G |
| S_9120514 \| \| scaffold14851_241083_SNP | 241083 | A | T |
| S_9120850 \| \| scaffold14851_244081_SNP | 244081 | T | C |
| S_9120870 \| \| scaffold14851_244274_SNP | 244274 | T | A |
| S_9120887 \| \| scaffold14851_244510_SNP | 244510 | C | G |
| S_9120938 \| \| scaffold14851_245488_SNP | 245488 | A | G |
| S_9121354 \| \| scaffold14851_250765_SNP | 250765 | A | G |
| $_9121381 \| \| scaffold14851_251251_SNP | 251251 | A | T |
| S_9121382 \| \| scaffold14851_251252_SNP | 251252 | G | A |
| S_9121432 \| \| scaffold14851_251890_SNP | 251890 | T | C |
| S_9121459 \| \| scaffold14851_252248_SNP | 252248 | C | T |
| S_9121462 \| \| scaffold14851_252338_SNP | 252338 | G | T |
| S_9121463 \| \| scaffold14851_252354_SNP | 252354 | C | T |
| S_9121468 \| \| scaffold14851_252427_SNP | 252427 | T | A |
| S_9121470 \| \| scaffold14851_252445_SNP | 252445 | T | C |
| S_9121471 \| \| scaffold14851_252506_SNP | 252506 | T | G |
| S_9121489 \| \| scaffold14851_252827_SNP | 252827 | A | C |
| S_9121490 \| \| scaffold14851_252853_SNP | 252853 | C | G |
| S_9121521 \| \| scaffold14851_253221_SNP | 253221 | A | C |
| S_9121571 \| \| scaffold14851_253738_SNP | 253738 | T | A |
| S_9121630 \| \| scaffold14851_254897_SNP | 254897 | A | T |
| S_9121631 \| \| scaffold14851_254907_SNP | 254907 | A | G |
| S_9121633 \| \| scaffold14851_254944_SNP | 254944 | C | T |
| S_9121637 \| \| scaffold14851_254993_SNP | 254993 | A | G |
| S_9121638 \| \| scaffold14851_255054_SNP | 255054 | G | T |
| S_9121692 \| \| scaffold14851_255319_SNP | 255319 | G | A |
| S_9121693 \| \| scaffold14851_255320_SNP | 255320 | A | T |
| S_9121694 \| \| scaffold14851_255321_SNP | 255321 | T | G |
| S_9121695 \| \| scaffold14851_255323_SNP | 255323 | C | A |
| S_9121716 \| \| scaffold14851_255610_SNP | 255610 | A | G |
| S_9121748 \| \| scaffold14851_256108_SNP | 256108 | C | T |
| S_9121764 \| \| scaffold14851_256230_SNP | 256230 | G | T |
| S_9121866 \| \| scaffold14851_257222_SNP | 257222 | T | C |
| S_9121871 \| \| scaffold14851_257470_SNP | 257470 | G | A |
| S_9121934 \| \| scaffold14851_258042_SNP | 258042 | C | T |
| S_9121941 \| \| scaffold14851_258178_SNP | 258178 | G | A |
| S_9121963 \| \| scaffold14851_258431_SNP | 258431 | C | G |
| S_9121964 \| \| scaffold14851_258434_SNP | 258434 | G | A |
| S_9121965 \| \| scaffold14851_258438_SNP | 258438 | C | T |
| S_9121969 \| \| scaffold14851_258473_SNP | 258473 | C | T |
| S_9121971 \| \| scaffold14851_258488_SNP | 258488 | C | T |
| S_9121973 \| \| scaffold14851_258512_SNP | 258512 | C | A |
| S_9121974 \| \| scaffold14851_258535_SNP | 258535 | A | G |
| S_9122017 \| \| scaffold14851_259210_SNP | 259210 | A | G |
| S_9122051 \| \| scaffold14851_259421_SNP | 259421 | G | C |
| S_9122055 \| \| scaffold14851_259443_SNP | 259443 | A | G |
| scaffold14851_259510_SNP | 259510 | T | C |
| scaffold14851_259524_SNP | 259524 | A | G |
| scaffold14851_259531_SNP | 259531 | C | A |
| S_9122245 \| \| scaffold14851_260142_SNP | 260142 | C | G |
| S_9122458 \| \| scaffold14851_261948_SNP | 261948 | C | T |
| S_9122573 \| \| scaffold14851_263314_SNP | 263314 | G | T |
| S_9122586 \| \| scaffold14851_263464_SNP | 263464 | G | A |
| S_9122638 \| \| scaffold14851_263973_SNP | 263973 | T | G |
| S_9123163 \| \| scaffold14851_270089_SNP | 270089 | C | G |
| S_9123176 \| \| scaffold14851_270422_SNP | 270422 | T | A |
| S_9123217 \| \| scaffold14851_270617_SNP | 270617 | C | A |
| S_9123222 \| \| scaffold14851_270631_SNP | 270631 | G | T |
| S_9123275 \| \| scaffold14851_271320_SNP | 271320 | T | G |
| S_9123597 \| \| scaffold14851_275511_SNP | 275511 | C | G |
| S_9123601 \| \| scaffold14851_275550_SNP | 275550 | G | A |
| S_9123604 \| \| scaffold14851_275589_SNP | 275589 | G | T |
| S_9123631 \| \| scaffold14851_275813_SNP | 275813 | A | G |
| S_9123928 \| \| scaffold14851_278435_SNP | 278435 | G | C |
| S_9123933 \| \| scaffold14851_278540_SNP | 278540 | A | T |
| S_9123934 \| \| scaffold14851_278541_SNP | 278541 | C | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9124383 \| \| scaffold14851_283692_SNP | 283692 | A | C |
| S_9124519 \| \| scaffold14851_285638_SNP | 285638 | T | C |
| S_9124611 \| \| scaffold14851_286914_SNP | 286914 | C | T |
| S_9124636 \| \| scaffold14851_287373_SNP | 287373 | C | T |
| S_9125010 \| \| scaffold14851_293572_SNP | 293572 | T | G |
| S_9125011 \| \| scaffold14851_293583_SNP | 293583 | T | A |
| S_9125012 \| \| scaffold14851_293584_SNP | 293584 | T | A |
| S_9125013 \| \| scaffold14851_293585_SNP | 293585 | T | A |
| S_9125014 \| \| scaffold14851_293635_SNP | 293635 | A | T |
| S_9125015 \| \| scaffold14851_293658_SNP | 293658 | T | A |
| S_9125016 \| \| scaffold14851_293680_SNP | 293680 | A | C |
| S_9125021 \| \| scaffold14851_293782_SNP | 293782 | G | A |
| S_9125023 \| \| scaffold14851_293809_SNP | 293809 | G | A |
| S_9125029 \| \| scaffold14851_294067_SNP | 294067 | C | T |
| S_9125046 \| \| scaffold14851_294360_SNP | 294360 | A | C |
| S_9125048 \| \| scaffold14851_294364_SNP | 294364 | A | C |
| S_9125117 \| \| scaffold14851_295200_SNP | 295200 | G | A |
| S_9125384 \| \| scaffold14851_298137_SNP | 298137 | A | C |
| S_9125385 \| \| scaffold14851_298154_SNP | 298154 | A | T |
| S_9125402 \| \| scaffold14851_298422_SNP | 298422 | G | A |
| S_9125403 \| \| scaffold14851_298424_SNP | 298424 | T | C |
| S_9125405 \| \| scaffold14851_298445_SNP | 298445 | T | C |
| S_9125605 \| \| scaffold14851_300654_SNP | 300654 | G | A |
| S_9125656 \| \| scaffold14851_301057_SNP | 301057 | G | A |
| S_9125764 \| \| scaffold14851_302481_SNP | 302481 | T | G |
| S_9125788 \| \| scaffold14851_303123_SNP | 303123 | A | C |
| S_9125790 \| \| scaffold14851_303158_SNP | 303158 | A | G |
| S_9125791 \| \| scaffold14851_303192_SNP | 303192 | T | A |
| S_9125833 \| \| scaffold14851_303918_SNP | 303918 | T | G |
| S_9125892 \| \| scaffold14851_304503_SNP | 304503 | A | G |
| S_9125909 \| \| scaffold14851_304940_SNP | 304940 | C | G |
| S_9125948 \| \| scaffold14851_305619_SNP | 305619 | T | C |
| S_9125953 \| \| scaffold14851_305733_SNP | 305733 | A | T |
| S_9125989 \| \| scaffold14851_306216_SNP | 306216 | A | G |
| S_9125990 \| \| scaffold14851_306224_SNP | 306224 | A | T |
| S_9126022 \| \| scaffold14851_306716_SNP | 306716 | G | C |
| S_9126023 \| \| scaffold14851_306719_SNP | 306719 | A | G |
| S_9126078 \| \| scaffold14851_307299_SNP | 307299 | A | G |
| S_9126096 \| \| scaffold14851_307471_SNP | 307471 | A | C |
| scaffold14851_307718_SNP | 307718 | T | A |
| S_9126133 \| \| scaffold14851_307720_SNP | 307720 | A | T |
| S_9126148 \| \| scaffold14851_308112_SNP | 308112 | C | T |
| S_9126154 \| \| scaffold14851_308296_SNP | 308296 | G | C |
| S_9126156 \| \| scaffold14851_308311_SNP | 308311 | T | G |
| S_9126169 \| \| scaffold14851_308587_SNP | 308587 | G | A |
| S_9126171 \| \| scaffold14851_308621_SNP | 308621 | A | C |
| S_9126293 \| \| scaffold14851_309819_SNP | 309819 | G | T |
| S_9126294 \| \| scaffold14851_309821_SNP | 309821 | T | A |
| S_9126303 \| \| scaffold14851_309904_SNP | 309904 | T | C |
| S_9126305 \| \| scaffold14851_309915_SNP | 309915 | A | T |
| S_9126311 \| \| scaffold14851_309952_SNP | 309952 | A | C |
| S_9126419 \| \| scaffold14851_311144_SNP | 311144 | G | A |
| S_9126447 \| \| scaffold14851_311545_SNP | 311545 | C | T |
| S_9126630 \| \| scaffold14851_313785_SNP | 313785 | T | A |
| S_9126677 \| \| scaffold14851_314297_SNP | 314297 | T | A |
| S_9126696 \| \| scaffold14851_314686_SNP | 314686 | C | T |
| S_9126731 \| \| scaffold14851_315242_SNP | 315242 | T | C |
| S_9126827 \| \| scaffold14851_316238_SNP | 316238 | C | A |
| S_9126856 \| \| scaffold14851_316723_SNP | 316723 | C | G |
| S_9126858 \| \| scaffold14851_316765_SNP | 316765 | G | A |
| S_9126878 \| \| scaffold14851_316999_SNP | 316999 | C | T |
| S_9126895 \| \| scaffold14851_317387_SNP | 317387 | T | C |
| S_9126896 \| \| scaffold14851_317391_SNP | 317391 | G | A |
| S_9126897 \| \| scaffold14851_317406_SNP | 317406 | A | G |
| S_9126925 \| \| scaffold14851_317646_SNP | 317646 | C | T |
| S_9126963 \| \| scaffold14851_317895_SNP | 317895 | C | T |
| S_9126965 \| \| scaffold14851_317917_SNP | 317917 | G | C |
| S_9127237 \| \| scaffold14851_319711_SNP | 319711 | C | T |
| S_9127249 \| \| scaffold14851_319965_SNP | 319965 | A | G |
| S_9127256 \| \| scaffold14851_320041_SNP | 320041 | C | G |
| S_9127272 \| \| scaffold14851_320460_SNP | 320460 | C | T |
| S_9127345 \| \| scaffold14851_321471_SNP | 321471 | C | T |
| S_9127406 \| \| scaffold14851_322384_SNP | 322384 | T | A |
| S_9127409 \| \| scaffold14851_322417_SNP | 322417 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9127417 \| \| scaffold14851_322529_SNP | 322529 | G | T |
| S_9127421 \| \| scaffold14851_322641_SNP | 322641 | C | T |
| S_9127496 \| \| scaffold14851_324200_SNP | 324200 | G | A |
| S_9127583 \| \| scaffold14851_325327_SNP | 325327 | C | T |
| S_9127627 \| \| scaffold14851_325652_SNP | 325652 | C | G |
| S_9127628 \| \| scaffold14851_325687_SNP | 325687 | G | A |
| S_9127701 \| \| scaffold14851_326315_SNP | 326315 | C | G |
| S_9127768 \| \| scaffold14851_327593_SNP | 327593 | C | A |
| S_9127811 \| \| scaffold14851_328579_SNP | 328579 | A | C |
| S_9127855 \| \| scaffold14851_329178_SNP | 329178 | G | A |
| S_9127900 \| \| scaffold14851_329741_SNP | 329741 | T | G |
| S_9127902 \| \| scaffold14851_329786_SNP | 329786 | T | C |
| S_9127960 \| \| scaffold14851_330871_SNP | 330871 | A | G |
| S_9127990 \| \| scaffold14851_331080_SNP | 331080 | C | T |
| S_9128002 \| \| scaffold14851_331296_SNP | 331296 | C | G |
| S_9128016 \| \| scaffold14851_331631_SNP | 331631 | C | T |
| S_9128058 \| \| scaffold14851_332334_SNP | 332334 | A | T |
| S_9128065 \| \| scaffold14851_332655_SNP | 332655 | C | A |
| S_9128122 \| \| scaffold14851_333609_SNP | 333609 | T | C |
| S_9128124 \| \| scaffold14851_333633_SNP | 333633 | G | T |
| S_9128225 \| \| scaffold14851_334966_SNP | 334966 | A | G |
| scaffold14851_335766_SNP | 335766 | T | A |
| S_9128337 \| \| scaffold14851_335772_SNP | 335772 | A | G |
| S_9128453 \| \| scaffold14851_337629_SNP | 337629 | T | C |
| S_9128468 \| \| scaffold14851_337894_SNP | 337894 | A | C |
| S_9128480 \| \| scaffold14851_338049_SNP | 338049 | A | C |
| S_9128522 \| \| scaffold14851_338775_SNP | 338775 | G | C |
| S_9128523 \| \| scaffold14851_338782_SNP | 338782 | C | T |
| S_9128553 \| \| scaffold14851_339279_SNP | 339279 | A | C |
| S_9128559 \| \| scaffold14851_339365_SNP | 339365 | G | T |
| S_9128620 \| \| scaffold14851_340019_SNP | 340019 | G | T |
| S_9128621 \| \| scaffold14851_340032_SNP | 340032 | G | A |
| S_9128622 \| \| scaffold14851_340044_SNP | 340044 | C | T |
| S_9128681 \| \| scaffold14851_341082_SNP | 341082 | T | C |
| S_9128702 \| \| scaffold14851_341315_SNP | 341315 | C | G |
| S_9128721 \| \| scaffold14851_341492_SNP | 341492 | C | T |
| S_9128724 \| \| scaffold14851_341519_SNP | 341519 | G | T |
| S_9128837 \| \| scaffold14851_344827_SNP | 344827 | G | A |
| S_9128845 \| \| scaffold14851_344939_SNP | 344939 | A | T |
| S_9128984 \| \| scaffold14851_346562_SNP | 346562 | T | C |
| S_9129080 \| \| scaffold14851_348070_SNP | 348070 | A | G |
| S_9129092 \| \| scaffold14851_348215_SNP | 348215 | C | G |
| S_9129132 \| \| scaffold14851_348427_SNP | 348427 | C | G |
| S_9129152 \| \| scaffold14851_348577_SNP | 348577 | C | G |
| S_9129169 \| \| scaffold14851_348894_SNP | 348894 | T | A |
| S_9129216 \| \| scaffold14851_349681_SNP | 349681 | C | T |
| S_9129265 \| \| scaffold14851_350118_SNP | 350118 | A | C |
| S_9129287 \| \| scaffold14851_350475_SNP | 350475 | G | A |
| S_9129289 \| \| scaffold14851_350547_SNP | 350547 | G | T |
| scaffold14851_352387_SNP | 352387 | T | C |
| S_9129547 \| \| scaffold14851_353239_SNP | 353239 | A | G |
| S_9129549 \| \| scaffold14851_353312_SNP | 353312 | A | T |
| S_9129566 \| \| scaffold14851_353623_SNP | 353623 | C | T |
| S_9129567 \| \| scaffold14851_353646_SNP | 353646 | C | T |
| S_9129580 \| \| scaffold14851_353855_SNP | 353855 | T | C |
| S_9129583 \| \| scaffold14851_353909_SNP | 353909 | G | A |
| S_9129595 \| \| scaffold14851_354051_SNP | 354051 | A | G |
| S_9129599 \| \| scaffold14851_354129_SNP | 354129 | C | G |
| S_9129601 \| \| scaffold14851_354181_SNP | 354181 | G | T |
| S_9129603 \| \| scaffold14851_354291_SNP | 354291 | A | T |
| S_9129607 \| \| scaffold14851_354334_SNP | 354334 | T | G |
| S_9129609 \| \| scaffold14851_354357_SNP | 354357 | G | A |
| S_9129612 \| \| scaffold14851_354410_SNP | 354410 | T | C |
| S_9129624 \| \| scaffold14851_354564_SNP | 354564 | T | G |
| S_9129627 \| \| scaffold14851_354600_SNP | 354600 | C | T |
| S_9129629 \| \| scaffold14851_354618_SNP | 354618 | T | C |
| S_9129641 \| \| scaffold14851_354784_SNP | 354784 | C | A |
| S_9129830 \| \| scaffold14851_357327_SNP | 357327 | T | C |
| S_9129838 \| \| scaffold14851_357473_SNP | 357473 | T | C |
| S_9129915 \| \| scaffold14851_358503_SNP | 358503 | T | A |
| S_9129983 \| \| scaffold14851_358811_SNP | 358811 | A | C |
| S_9130001 \| \| scaffold14851_359023_SNP | 359023 | G | A |
| S_9130004 \| \| scaffold14851_359052_SNP | 359052 | T | G |
| S_9130014 \| \| scaffold14851_359123_SNP | 359123 | T | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9130022 \|\| scaffold14851_359290_SNP | 359290 | T | G |
| S_9130026 \|\| scaffold14851_359392_SNP | 359392 | C | T |
| S_9130040 \|\| scaffold14851_359589_SNP | 359589 | A | G |
| S_9130099 \|\| scaffold14851_360141_SNP | 360141 | C | T |
| S_9130105 \|\| scaffold14851_360168_SNP | 360168 | T | A |
| S_9130131 \|\| scaffold14851_360487_SNP | 360487 | A | G |
| S_9130133 \|\| scaffold14851_360515_SNP | 360515 | A | T |
| S_9130196 \|\| scaffold14851_360985_SNP | 360985 | T | C |
| S_9130198 \|\| scaffold14851_360990_SNP | 360990 | C | T |
| S_9130206 \|\| scaffold14851_361029_SNP | 361029 | T | C |
| S_9130345 \|\| scaffold14851_363475_SNP | 363475 | A | G |
| S_9130504 \|\| scaffold14851_366163_SNP | 366163 | A | G |
| S_9130538 \|\| scaffold14851_366349_SNP | 366349 | T | A |
| S_9130578 \|\| scaffold14851_367031_SNP | 367031 | G | A |
| S_9130626 \|\| scaffold14851_367825_SNP | 367825 | A | C |
| S_9130657 \|\| scaffold14851_368398_SNP | 368398 | T | G |
| S_9130819 \|\| scaffold14851_370159_SNP | 370159 | G | T |
| S_9130820 \|\| scaffold14851_370161_SNP | 370161 | G | A |
| S_9130821 \|\| scaffold14851_370162_SNP | 370162 | A | T |
| S_9130822 \|\| scaffold14851_370204_SNP | 370204 | T | C |
| S_9131320 \|\| scaffold14851_376732_SNP | 376732 | G | A |
| S_9131323 \|\| scaffold14851_376793_SNP | 376793 | G | A |
| S_9131330 \|\| scaffold14851_376983_SNP | 376983 | A | T |
| S_9131452 \|\| scaffold14851_378373_SNP | 378373 | G | C |
| S_9131453 \|\| scaffold14851_378388_SNP | 378388 | G | T |
| S_9131458 \|\| scaffold14851_378473_SNP | 378473 | G | C |
| S_9131461 \|\| scaffold14851_378567_SNP | 378567 | C | T |
| S_9131464 \|\| scaffold14851_378677_SNP | 378677 | C | A |
| S_9131478 \|\| scaffold14851_379027_SNP | 379027 | C | T |
| S_9131479 \|\| scaffold14851_379033_SNP | 379033 | G | T |
| S_9131480 \|\| scaffold14851_379047_SNP | 379047 | T | G |
| S_9131498 \|\| scaffold14851_379225_SNP | 379225 | A | C |
| S_9131523 \|\| scaffold14851_379740_SNP | 379740 | G | A |
| S_9131526 \|\| scaffold14851_379775_SNP | 379775 | C | A |
| S_9131530 \|\| scaffold14851_379819_SNP | 379819 | A | C |
| S_9131532 \|\| scaffold14851_379846_SNP | 379846 | C | A |
| S_9131540 \|\| scaffold14851_379957_SNP | 379957 | T | G |
| S_9131543 \|\| scaffold14851_379995_SNP | 379995 | C | T |
| S_9131558 \|\| scaffold14851_380158_SNP | 380158 | G | A |
| S_9131565 \|\| scaffold14851_380224_SNP | 380224 | G | A |
| S_9131569 \|\| scaffold14851_380250_SNP | 380250 | T | G |
| S_9131570 \|\| scaffold14851_380253_SNP | 380253 | C | G |
| S_9131575 \|\| scaffold14851_380340_SNP | 380340 | C | G |
| S_9131576 \|\| scaffold14851_380350_SNP | 380350 | A | G |
| S_9131690 \|\| scaffold14851_381535_SNP | 381535 | T | C |
| S_9131779 \|\| scaffold14851_382884_SNP | 382884 | G | A |
| S_9131813 \|\| scaffold14851_383229_SNP | 383229 | G | A |
| S_9131815 \|\| scaffold14851_383235_SNP | 383235 | C | T |
| S_9131816 \|\| scaffold14851_383245_SNP | 383245 | A | G |
| S_9131856 \|\| scaffold14851_383717_SNP | 383717 | G | T |
| S_9131857 \|\| scaffold14851_383725_SNP | 383725 | G | T |
| S_9131864 \|\| scaffold14851_383871_SNP | 383871 | C | T |
| S_9131867 \|\| scaffold14851_383941_SNP | 383941 | A | G |
| S_9131930 \|\| scaffold14851_384333_SNP | 384333 | C | G |
| S_9131934 \|\| scaffold14851_384371_SNP | 384371 | C | T |
| S_9132030 \|\| scaffold14851_384823_SNP | 384823 | T | C |
| S_9132316 \|\| scaffold14851_386965_SNP | 386965 | C | A |
| S_9132372 \|\| scaffold14851_387063_SNP | 387063 | C | A |
| S_9132448 \|\| scaffold14851_388712_SNP | 388712 | C | G |
| S_9132457 \|\| scaffold14851_388855_SNP | 388855 | C | T |
| S_9132644 \|\| scaffold14851_390666_SNP | 390666 | T | G |
| S_9132654 \|\| scaffold14851_390898_SNP | 390898 | T | A |
| S_9132868 \|\| scaffold14851_392337_SNP | 392337 | T | C |
| S_9132869 \|\| scaffold14851_392344_SNP | 392344 | C | T |
| S_9132896 \|\| scaffold14851_392570_SNP | 392570 | C | T |
| S_9133259 \|\| scaffold14851_397585_SNP | 397585 | C | T |
| S_9133332 \|\| scaffold14851_398649_SNP | 398649 | G | A |
| S_9133372 \|\| scaffold14851_398787_SNP | 398787 | A | C |
| S_9133446 \|\| scaffold14851_399332_SNP | 399332 | T | C |
| S_9133487 \|\| scaffold14851_400234_SNP | 400234 | C | T |
| S_9133567 \|\| scaffold14851_401670_SNP | 401670 | T | A |
| S_9133593 \|\| scaffold14851_402006_SNP | 402006 | T | C |
| S_9133597 \|\| scaffold14851_402083_SNP | 402083 | G | A |
| S_9133619 \|\| scaffold14851_402280_SNP | 402280 | G | A |

TABLE 1-continued

<u>SNP Positions within SEQ ID NO: 1 that are associated with increased resistance to ASR</u>

| Name | Position SEQ ID NO: 1 | Favorabale Allele (Rust Resistant) | Unfavorable Allele (Rust Susceptible) |
|---|---|---|---|
| S_9133641 \| \| scaffold14851_402563_SNP | 402563 | T | C |
| S_9133655 \| \| scaffold14851_402783_SNP | 402783 | A | C |
| S_9133657 \| \| scaffold14851_402796_SNP | 402796 | A | G |
| S_9133658 \| \| scaffold14851_402811_SNP | 402811 | A | T |
| S_9133663 \| \| scaffold14851_402990_SNP | 402990 | C | A |
| S_9133685 \| \| scaffold14851_403275_SNP | 403275 | C | G |
| S_9133771 \| \| scaffold14851_404072_SNP | 404072 | A | C |
| S_9133797 \| \| scaffold14851_404532_SNP | 404532 | A | C |
| S_9133813 \| \| scaffold14851_404831_SNP | 404831 | A | G |
| S_9133825 \| \| scaffold14851_405067_SNP | 405067 | A | G |
| S_9133870 \| \| scaffold14851_406067_SNP | 406067 | C | A |
| S_9133976 \| \| scaffold14851_407021_SNP | 407021 | T | C |
| S_9134081 \| \| scaffold14851_407836_SNP | 407836 | A | T |
| S_9134097 \| \| scaffold14851_408109_SNP | 408109 | C | A |
| S_9134101 \| \| scaffold14851_408234_SNP | 408234 | T | C |
| S_9134158 \| \| scaffold14851_409032_SNP | 409032 | T | G |
| S_9134159 \| \| scaffold14851_409033_SNP | 409033 | G | A |
| S_9134160 \| \| scaffold14851_409074_SNP | 409074 | A | G |
| S_9134170 \| \| scaffold14851_409200_SNP | 409200 | C | T |
| S_9134181 \| \| scaffold14851_409543_SNP | 409543 | C | G |
| S_9134324 \| \| scaffold14851_411458_SNP | 411458 | A | G |
| S_9134330 \| \| scaffold14851_411513_SNP | 411513 | C | G |
| S_9134566 \| \| scaffold14851_414575_SNP | 414575 | C | G |
| S_9134571 \| \| scaffold14851_414691_SNP | 414691 | A | T |
| S_9134573 \| \| scaffold14851_414694_SNP | 414694 | T | C |
| S_9134699 \| \| scaffold14851_415390_SNP | 415390 | G | A |
| S_9134716 \| \| scaffold14851_415736_SNP | 415736 | C | T |
| S_9134726 \| \| scaffold14851_415840_SNP | 415840 | T | A |
| S_9134768 \| \| scaffold14851_416353_SNP | 416353 | A | G |
| S_9134770 \| \| scaffold14851_416368_SNP | 416368 | T | C |
| S_9134827 \| \| scaffold14851_417270_SNP | 417270 | C | A |
| S_9134866 \| \| scaffold14851_417954_SNP | 417954 | T | G |
| S_9134867 \| \| scaffold14851_418028_SNP | 418028 | G | A |
| S_9134886 \| \| scaffold14851_418346_SNP | 418346 | C | G |
| S_9134966 \| \| scaffold14851_419287_SNP | 419287 | C | T |
| S_9135002 \| \| scaffold14851_419772_SNP | 419772 | T | C |
| S_9135003 \| \| scaffold14851_419774_SNP | 419774 | G | T |
| S_9135081 \| \| scaffold14851_420685_SNP | 420685 | G | A |
| S_9135159 \| \| scaffold14851_421251_SNP | 421251 | G | C |
| S_9135160 \| \| scaffold14851_421256_SNP | 421256 | A | T |
| S_9135161 \| \| scaffold14851_421266_SNP | 421266 | A | G |
| S_9135164 \| \| scaffold14851_421354_SNP | 421354 | G | T |
| S_9135191 \| \| scaffold14851_421765_SNP | 421765 | A | C |
| S_9135194 \| \| scaffold14851_421936_SNP | 421936 | G | A |
| S_9135219 \| \| scaffold14851_422243_SNP | 422243 | T | C |
| S_9135231 \| \| scaffold14851_422373_SNP | 422373 | G | T |
| S_9135250 \| \| scaffold14851_422609_SNP | 422609 | T | C |
| S_9135255 \| \| scaffold14851_422657_SNP | 422657 | A | C |
| S_9135264 \| \| scaffold14851_422785_SNP | 422785 | T | G |
| S_9135270 \| \| scaffold14851_422816_SNP | 422816 | A | T |
| S_9135280 \| \| scaffold14851_422955_SNP | 422955 | G | A |
| S_9135313 \| \| scaffold14851_423379_SNP | 423379 | G | C |
| S_9135337 \| \| scaffold14851_423825_SNP | 423825 | A | T |
| S_9135341 \| \| scaffold14851_423915_SNP | 423915 | G | A |
| S_9135343 \| \| scaffold14851_423950_SNP | 423950 | G | T |
| S_9135440 \| \| scaffold14851_425232_SNP | 425232 | T | C |
| S_9135441 \| \| scaffold14851_425243_SNP | 425243 | T | C |
| S_9135511 \| \| scaffold14851_426398_SNP | 426398 | C | A |
| S_9135513 \| \| scaffold14851_426451_SNP | 426451 | C | A |
| S_9135559 \| \| scaffold14851_426771_SNP | 426771 | C | A |
| S_9135775 \| \| scaffold14851_429398_SNP | 429398 | T | A |
| S_9136669 \| \| scaffold14851_434789_SNP | 434789 | G | A |
| S_9136676 \| \| scaffold14851_434936_SNP | 434936 | T | A |
| S_9136723 \| \| scaffold14851_435711_SNP | 435711 | A | C |
| S_9136753 \| \| scaffold14851_436210_SNP | 436210 | T | C |
| S_9136802 \| \| scaffold14851_436880_SNP | 436880 | A | G |
| S_9136803 \| \| scaffold14851_436889_SNP | 436889 | A | T |
| S_9136804 \| \| scaffold14851_436898_SNP | 436898 | A | T |
| S_9136842 \| \| scaffold14851_437421_SNP | 437421 | T | C |
| S_9136994 \| \| scaffold14851_439598_SNP | 439598 | C | G |
| S_9137172 \| \| scaffold14851_441483_SNP | 441483 | G | T |
| S_9137238 \| \| scaffold14851_442480_SNP | 442480 | G | T |
| S_9137239 \| \| scaffold14851_442511_SNP | 442511 | C | A |
| S_9137338 \| \| scaffold14851_444846_SNP | 444846 | G | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9137349 \| \| scaffold14851_444963_SNP | 444963 | A | G |
| S_9137486 \| \| scaffold14851_445405_SNP | 445405 | A | G |
| S_9137691 \| \| scaffold14851_448365_SNP | 448365 | C | A |
| S_9137750 \| \| scaffold14851_449044_SNP | 449044 | T | G |
| S_9137853 \| \| scaffold14851_450011_SNP | 450011 | G | A |
| S_9137899 \| \| scaffold14851_451355_SNP | 451355 | A | G |
| S_9137917 \| \| scaffold14851_451435_SNP | 451435 | C | T |
| S_9137930 \| \| scaffold14851_451716_SNP | 451716 | A | T |
| S_9138057 \| \| scaffold14851_453195_SNP | 453195 | A | G |
| S_9138063 \| \| scaffold14851_453344_SNP | 453344 | G | C |
| S_9138128 \| \| scaffold14851_454472_SNP | 454472 | C | T |
| S_9138129 \| \| scaffold14851_454523_SNP | 454523 | G | A |
| S_9138250 \| \| scaffold14851_455419_SNP | 455419 | T | G |
| S_9138265 \| \| scaffold14851_455693_SNP | 455693 | G | A |
| S_9138266 \| \| scaffold14851_455697_SNP | 455697 | A | T |
| S_9138267 \| \| scaffold14851_455716_SNP | 455716 | C | T |
| S_9138270 \| \| scaffold14851_455865_SNP | 455865 | A | G |
| S_9138335 \| \| scaffold14851_457015_SNP | 457015 | G | A |
| S_9138425 \| \| scaffold14851_458213_SNP | 458213 | A | T |
| S_9138548 \| \| scaffold14851_461812_SNP | 461812 | G | T |
| S_9138586 \| \| scaffold14851_462643_SNP | 462643 | T | C |
| S_9138589 \| \| scaffold14851_462656_SNP | 462656 | A | G |
| S_9138603 \| \| scaffold14851_462790_SNP | 462790 | A | T |
| S_9138614 \| \| scaffold14851_462929_SNP | 462929 | A | G |
| S_9138616 \| \| scaffold14851_462954_SNP | 462954 | A | G |
| S_9138618 \| \| scaffold14851_462964_SNP | 462964 | G | T |
| S_9138659 \| \| scaffold14851_463818_SNP | 463818 | A | G |
| S_9138660 \| \| scaffold14851_463868_SNP | 463868 | A | C |
| S_9138661 \| \| scaffold14851_463958_SNP | 463958 | C | T |
| S_9138667 \| \| scaffold14851_464097_SNP | 464097 | G | A |
| S_9138756 \| \| scaffold14851_465482_SNP | 465482 | G | A |
| S_9138785 \| \| scaffold14851_465766_SNP | 465766 | C | G |
| S_9138816 \| \| scaffold14851_466171_SNP | 466171 | C | T |
| S_9138841 \| \| scaffold14851_466314_SNP | 466314 | A | C |
| S_9138855 \| \| scaffold14851_466332_SNP | 466332 | G | C |
| S_9138895 \| \| scaffold14851_466584_SNP | 466584 | T | A |
| S_9138975 \| \| scaffold14851_467592_SNP | 467592 | T | A |
| S_9138976 \| \| scaffold14851_467599_SNP | 467599 | C | G |
| S_9138992 \| \| scaffold14851_468024_SNP | 468024 | A | G |
| S_9139023 \| \| scaffold14851_468486_SNP | 468486 | A | G |
| S_9139044 \| \| scaffold14851_468833_SNP | 468833 | C | T |
| scaffold14851_468849_SNP | 468849 | G | A |
| S_9139166 \| \| scaffold14851_469888_SNP | 469888 | C | T |
| S_9139181 \| \| scaffold14851_470094_SNP | 470094 | G | A |
| S_9139193 \| \| scaffold14851_470362_SNP | 470362 | T | C |
| S_9139223 \| \| scaffold14851_470789_SNP | 470789 | T | C |
| S_9139306 \| \| scaffold14851_471802_SNP | 471802 | T | G |
| S_9139370 \| \| scaffold14851_472687_SNP | 472687 | C | A |
| S_9139384 \| \| scaffold14851_473007_SNP | 473007 | G | A |
| S_9139448 \| \| scaffold14851_474062_SNP | 474062 | A | G |
| S_9139918 \| \| scaffold14851_478547_SNP | 478547 | G | T |
| S_9139922 \| \| scaffold14851_478574_SNP | 478574 | T | A |
| S_9139930 \| \| scaffold14851_478637_SNP | 478637 | G | C |
| S_9140027 \| \| scaffold14851_480027_SNP | 480027 | A | T |
| S_9140034 \| \| scaffold14851_480252_SNP | 480252 | A | G |
| S_9140036 \| \| scaffold14851_480267_SNP | 480267 | A | G |
| S_9140323 \| \| scaffold14851_483448_SNP | 483448 | G | T |
| S_9140361 \| \| scaffold14851_483777_SNP | 483777 | C | T |
| S_9140531 \| \| scaffold14851_486307_SNP | 486307 | G | T |
| S_9140535 \| \| scaffold14851_486339_SNP | 486339 | C | G |
| S_9140599 \| \| scaffold14851_487142_SNP | 487142 | T | C |
| S_9140620 \| \| scaffold14851_487342_SNP | 487342 | G | A |
| S_9140624 \| \| scaffold14851_487403_SNP | 487403 | C | G |
| S_9140642 \| \| scaffold14851_487577_SNP | 487577 | G | A |
| S_9140896 \| \| scaffold14851_489873_SNP | 489873 | C | T |
| S_9140974 \| \| scaffold14851_490904_SNP | 490904 | G | T |
| S_9141070 \| \| scaffold14851_492200_SNP | 492200 | G | A |
| S_9141072 \| \| scaffold14851_492333_SNP | 492333 | T | A |
| scaffold14851_493327_SNP | 493327 | A | T |
| scaffold14851_493363_SNP | 493363 | G | A |
| S_9141226 \| \| scaffold14851_493493_SNP | 493493 | T | C |
| S_9141231 \| \| scaffold14851_493580_SNP | 493580 | C | T |
| S_9141320 \| \| scaffold14851_494959_SNP | 494959 | T | A |
| S_9141363 \| \| scaffold14851_495531_SNP | 495531 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9141457 \|\| scaffold14851_496773_SNP | 496773 | T | G |
| S_9141461 \|\| scaffold14851_496814_SNP | 496814 | C | T |
| S_9141473 \|\| scaffold14851_496946_SNP | 496946 | A | T |
| S_9141474 \|\| scaffold14851_496956_SNP | 496956 | C | G |
| S_9141497 \|\| scaffold14851_497211_SNP | 497211 | A | T |
| S_9141539 \|\| scaffold14851_497852_SNP | 497852 | A | T |
| S_9141680 \|\| scaffold14851_498944_SNP | 498944 | T | C |
| S_9141681 \|\| scaffold14851_498959_SNP | 498959 | G | C |
| S_9141684 \|\| scaffold14851_499060_SNP | 499060 | G | T |
| S_9141688 \|\| scaffold14851_499101_SNP | 499101 | T | G |
| S_9141689 \|\| scaffold14851_499160_SNP | 499160 | C | T |
| S_9142540 \|\| scaffold14851_509524_SNP | 509524 | T | C |
| S_9142541 \|\| scaffold14851_509525_SNP | 509525 | T | C |
| S_9142626 \|\| scaffold14851_510516_SNP | 510516 | A | C |
| S_9142627 \|\| scaffold14851_510517_SNP | 510517 | C | T |
| S_9142820 \|\| scaffold14851_514279_SNP | 514279 | A | G |
| S_9142837 \|\| scaffold14851_514501_SNP | 514501 | G | A |
| S_9142849 \|\| scaffold14851_514663_SNP | 514663 | A | T |
| S_9142859 \|\| scaffold14851_514853_SNP | 514853 | T | G |
| S_9142963 \|\| scaffold14851_517185_SNP | 517185 | A | T |
| S_9142974 \|\| scaffold14851_517392_SNP | 517392 | A | G |
| S_9142991 \|\| scaffold14851_517641_SNP | 517641 | T | A |
| S_9143000 \|\| scaffold14851_517805_SNP | 517805 | T | C |
| S_9143048 \|\| scaffold14851_518193_SNP | 518193 | C | T |
| S_9143065 \|\| scaffold14851_518329_SNP | 518329 | A | G |
| S_9143093 \|\| scaffold14851_518682_SNP | 518682 | C | T |
| S_9143095 \|\| scaffold14851_518702_SNP | 518702 | A | G |
| S_9143132 \|\| scaffold14851_519075_SNP | 519075 | C | T |
| S_9143133 \|\| scaffold14851_519087_SNP | 519087 | C | T |
| S_9143155 \|\| scaffold14851_519319_SNP | 519319 | C | G |
| S_9143157 \|\| scaffold14851_519326_SNP | 519326 | A | G |
| S_9143173 \|\| scaffold14851_519487_SNP | 519487 | T | C |
| S_9143184 \|\| scaffold14851_519544_SNP | 519544 | A | G |
| S_9143189 \|\| scaffold14851_519632_SNP | 519632 | A | G |
| S_9143235 \|\| scaffold14851_519902_SNP | 519902 | T | C |
| S_9143242 \|\| scaffold14851_520071_SNP | 520071 | C | T |
| S_9143249 \|\| scaffold14851_520176_SNP | 520176 | T | C |
| S_9143253 \|\| scaffold14851_520259_SNP | 520259 | C | T |
| S_9143259 \|\| scaffold14851_520350_SNP | 520350 | T | C |
| scaffold14851_521206_SNP | 521206 | G | A |
| S_9143572 \|\| scaffold14851_523585_SNP | 523585 | T | C |
| S_9143604 \|\| scaffold14851_524059_SNP | 524059 | T | C |
| S_9143631 \|\| scaffold14851_524288_SNP | 524288 | A | T |
| S_9143658 \|\| scaffold14851_524685_SNP | 524685 | G | A |
| S_9143674 \|\| scaffold14851_524990_SNP | 524990 | A | T |
| S_9143694 \|\| scaffold14851_525347_SNP | 525347 | T | A |
| S_9143704 \|\| scaffold14851_525434_SNP | 525434 | T | A |
| S_9143725 \|\| scaffold14851_525772_SNP | 525772 | T | G |
| S_9143732 \|\| scaffold14851_525864_SNP | 525864 | G | T |
| S_9143743 \|\| scaffold14851_526120_SNP | 526120 | G | A |
| S_9143749 \|\| scaffold14851_526169_SNP | 526169 | T | G |
| S_9143761 \|\| scaffold14851_526380_SNP | 526380 | T | G |
| S_9143795 \|\| scaffold14851_526942_SNP | 526942 | C | T |
| S_9143802 \|\| scaffold14851_527108_SNP | 527108 | A | G |
| S_9143816 \|\| scaffold14851_527194_SNP | 527194 | C | T |
| S_9143821 \|\| scaffold14851_527296_SNP | 527296 | A | G |
| S_9143864 \|\| scaffold14851_527999_SNP | 527999 | A | G |
| S_9143916 \|\| scaffold14851_528946_SNP | 528946 | A | G |
| S_9143951 \|\| scaffold14851_529353_SNP | 529353 | A | G |
| S_9144037 \|\| scaffold14851_530908_SNP | 530908 | G | A |
| S_9144167 \|\| scaffold14851_533059_SNP | 533059 | C | T |
| S_9144221 \|\| scaffold14851_533960_SNP | 533960 | A | C |
| S_9144265 \|\| scaffold14851_534923_SNP | 534923 | C | A |
| S_9144305 \|\| scaffold14851_535513_SNP | 535513 | G | T |
| S_9144366 \|\| scaffold14851_536471_SNP | 536471 | A | G |
| S_9144490 \|\| scaffold14851_538073_SNP | 538073 | C | T |
| S_9144492 \|\| scaffold14851_538086_SNP | 538086 | A | G |
| S_9144624 \|\| scaffold14851_540098_SNP | 540098 | T | C |
| S_9144820 \|\| scaffold14851_542578_SNP | 542578 | G | A |
| S_9144917 \|\| scaffold14851_543842_SNP | 543842 | A | C |
| S_9145082 \|\| scaffold14851_546673_SNP | 546673 | A | T |
| S_9145137 \|\| scaffold14851_548068_SNP | 548068 | G | T |
| S_9145138 \|\| scaffold14851_548075_SNP | 548075 | T | A |
| S_9145182 \|\| scaffold14851_548510_SNP | 548510 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9145194 \| \| scaffold14851_548733_SNP | 548733 | G | T |
| S_9145254 \| \| scaffold14851_549785_SNP | 549785 | C | T |
| S_9145466 \| \| scaffold14851_553451_SNP | 553451 | T | G |
| S_9145496 \| \| scaffold14851_553955_SNP | 553955 | A | G |
| S_9145540 \| \| scaffold14851_554598_SNP | 554598 | A | G |
| S_9145557 \| \| scaffold14851_554899_SNP | 554899 | G | A |
| S_9145600 \| \| scaffold14851_554995_SNP | 554995 | C | T |
| S_9145638 \| \| scaffold14851_555239_SNP | 555239 | C | T |
| S_9145680 \| \| scaffold14851_555302_SNP | 555302 | G | A |
| S_9145705 \| \| scaffold14851_555485_SNP | 555485 | A | C |
| S_9145719 \| \| scaffold14851_555679_SNP | 555679 | C | G |
| S_9145721 \| \| scaffold14851_555696_SNP | 555696 | A | T |
| S_9145744 \| \| scaffold14851_556074_SNP | 556074 | C | T |
| S_9145751 \| \| scaffold14851_556249_SNP | 556249 | G | T |
| S_9145767 \| \| scaffold14851_556512_SNP | 556512 | T | C |
| S_9145799 \| \| scaffold14851_556931_SNP | 556931 | G | A |
| S_9145816 \| \| scaffold14851_557139_SNP | 557139 | C | T |
| S_9145837 \| \| scaffold14851_557422_SNP | 557422 | T | C |
| S_9145844 \| \| scaffold14851_557501_SNP | 557501 | A | G |
| S_9145959 \| \| scaffold14851_559093_SNP | 559093 | C | A |
| S_9145960 \| \| scaffold14851_559105_SNP | 559105 | T | C |
| S_9145992 \| \| scaffold14851_559592_SNP | 559592 | A | G |
| S_9145993 \| \| scaffold14851_559595_SNP | 559595 | G | A |
| S_9146428 \| \| scaffold14851_562289_SNP | 562289 | C | T |
| S_9146684 \| \| scaffold14851_563985_SNP | 563985 | T | G |
| S_9146710 \| \| scaffold14851_564605_SNP | 564605 | G | T |
| S_9146794 \| \| scaffold14851_565859_SNP | 565859 | C | A |
| S_9146801 \| \| scaffold14851_565953_SNP | 565953 | T | C |
| S_9146822 \| \| scaffold14851_566106_SNP | 566106 | A | T |
| S_9146843 \| \| scaffold14851_566440_SNP | 566440 | A | T |
| S_9146845 \| \| scaffold14851_566456_SNP | 566456 | C | A |
| S_9146952 \| \| scaffold14851_572464_SNP | 572464 | G | A |
| S_9146954 \| \| scaffold14851_572537_SNP | 572537 | A | T |
| S_9146978 \| \| scaffold14851_572812_SNP | 572812 | C | T |
| S_9146986 \| \| scaffold14851_573027_SNP | 573027 | T | G |
| S_9146996 \| \| scaffold14851_573273_SNP | 573273 | T | C |
| S_9146997 \| \| scaffold14851_573291_SNP | 573291 | C | T |
| S_9147002 \| \| scaffold14851_573372_SNP | 573372 | C | T |
| S_9147003 \| \| scaffold14851_573382_SNP | 573382 | C | T |
| S_9147008 \| \| scaffold14851_573452_SNP | 573452 | G | A |
| S_9147009 \| \| scaffold14851_573467_SNP | 573467 | A | G |
| S_9147011 \| \| scaffold14851_573482_SNP | 573482 | G | A |
| S_9147044 \| \| scaffold14851_573857_SNP | 573857 | A | G |
| S_9147047 \| \| scaffold14851_573866_SNP | 573866 | C | T |
| S_9147048 \| \| scaffold14851_573884_SNP | 573884 | C | T |
| S_9147049 \| \| scaffold14851_573899_SNP | 573899 | C | T |
| S_9147085 \| \| scaffold14851_574311_SNP | 574311 | C | T |
| S_9147086 \| \| scaffold14851_574321_SNP | 574321 | G | A |
| S_9147094 \| \| scaffold14851_574404_SNP | 574404 | G | A |
| S_9147096 \| \| scaffold14851_574431_SNP | 574431 | C | A |
| S_9147097 \| \| scaffold14851_574434_SNP | 574434 | G | T |
| S_9147106 \| \| scaffold14851_574526_SNP | 574526 | G | A |
| S_9147107 \| \| scaffold14851_574542_SNP | 574542 | C | T |
| S_9147108 \| \| scaffold14851_574545_SNP | 574545 | A | G |
| S_9147115 \| \| scaffold14851_574650_SNP | 574650 | C | T |
| S_9147121 \| \| scaffold14851_574698_SNP | 574698 | T | C |
| S_9147123 \| \| scaffold14851_574715_SNP | 574715 | G | A |
| S_9147125 \| \| scaffold14851_574725_SNP | 574725 | C | T |
| S_9147202 \| \| scaffold14851_575320_SNP | 575320 | A | T |
| S_9147242 \| \| scaffold14851_575408_SNP | 575408 | A | G |
| S_9147250 \| \| scaffold14851_575514_SNP | 575514 | C | T |
| S_9147256 \| \| scaffold14851_575602_SNP | 575602 | G | A |
| S_9147303 \| \| scaffold14851_576182_SNP | 576182 | G | C |
| S_9147325 \| \| scaffold14851_576352_SNP | 576352 | C | G |
| S_9147437 \| \| scaffold14851_577536_SNP | 577536 | A | G |
| S_9147476 \| \| scaffold14851_577792_SNP | 577792 | G | T |
| S_9147479 \| \| scaffold14851_577803_SNP | 577803 | A | T |
| S_9147488 \| \| scaffold14851_577873_SNP | 577873 | A | G |
| S_9147826 \| \| scaffold14851_581189_SNP | 581189 | G | A |
| S_9147828 \| \| scaffold14851_581198_SNP | 581198 | T | C |
| S_9147970 \| \| scaffold14851_583090_SNP | 583090 | A | T |
| S_9147993 \| \| scaffold14851_583419_SNP | 583419 | T | C |
| S_9147997 \| \| scaffold14851_583692_SNP | 583692 | T | C |
| S_9148089 \| \| scaffold14851_584402_SNP | 584402 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9148120 \| \| scaffold14851_584958_SNP | 584958 | T | G |
| S_9148144 \| \| scaffold14851_585259_SNP | 585259 | C | T |
| S_9148148 \| \| scaffold14851_585277_SNP | 585277 | T | A |
| S_9148150 \| \| scaffold14851_585331_SNP | 585331 | C | T |
| S_9148242 \| \| scaffold14851_587210_SNP | 587210 | C | T |
| S_9148295 \| \| scaffold14851_587970_SNP | 587970 | A | T |
| S_9148310 \| \| scaffold14851_588322_SNP | 588322 | C | G |
| S_9148314 \| \| scaffold14851_588371_SNP | 588371 | G | T |
| S_9148316 \| \| scaffold14851_588426_SNP | 588426 | A | G |
| S_9148326 \| \| scaffold14851_588684_SNP | 588684 | A | C |
| S_9148441 \| \| scaffold14851_590098_SNP | 590098 | A | G |
| S_9148448 \| \| scaffold14851_590181_SNP | 590181 | C | T |
| S_9148459 \| \| scaffold14851_590332_SNP | 590332 | T | C |
| S_9148508 \| \| scaffold14851_591051_SNP | 591051 | C | G |
| S_9148549 \| \| scaffold14851_591772_SNP | 591772 | C | T |
| S_9148641 \| \| scaffold14851_592585_SNP | 592585 | T | C |
| S_9148643 \| \| scaffold14851_592626_SNP | 592626 | T | G |
| S_9148649 \| \| scaffold14851_592704_SNP | 592704 | C | T |
| S_9148656 \| \| scaffold14851_592785_SNP | 592785 | T | C |
| S_9148663 \| \| scaffold14851_592858_SNP | 592858 | T | C |
| S_9148665 \| \| scaffold14851_592910_SNP | 592910 | A | G |
| S_9148666 \| \| scaffold14851_592914_SNP | 592914 | C | T |
| S_9148668 \| \| scaffold14851_592971_SNP | 592971 | G | A |
| S_9148672 \| \| scaffold14851_593036_SNP | 593036 | G | C |
| S_9148685 \| \| scaffold14851_593405_SNP | 593405 | T | G |
| S_9148686 \| \| scaffold14851_593425_SNP | 593425 | A | T |
| S_9148689 \| \| scaffold14851_593454_SNP | 593454 | T | C |
| S_9148699 \| \| scaffold14851_593575_SNP | 593575 | C | T |
| S_9148702 \| \| scaffold14851_593597_SNP | 593597 | G | A |
| S_9148738 \| \| scaffold14851_593961_SNP | 593961 | A | C |
| S_9149037 \| \| scaffold14851_596493_SNP | 596493 | A | G |
| S_9149039 \| \| scaffold14851_596512_SNP | 596512 | T | G |
| S_9149040 \| \| scaffold14851_596518_SNP | 596518 | A | T |
| S_9149044 \| \| scaffold14851_596579_SNP | 596579 | G | A |
| S_9149047 \| \| scaffold14851_596601_SNP | 596601 | C | T |
| S_9149060 \| \| scaffold14851_596692_SNP | 596692 | A | G |
| S_9149177 \| \| scaffold14851_597865_SNP | 597865 | A | G |
| S_9149185 \| \| scaffold14851_598000_SNP | 598000 | A | G |
| S_9149194 \| \| scaffold14851_598142_SNP | 598142 | T | C |
| S_9149197 \| \| scaffold14851_598175_SNP | 598175 | G | A |
| S_9149215 \| \| scaffold14851_598523_SNP | 598523 | A | C |
| S_9149246 \| \| scaffold14851_598564_SNP | 598564 | T | G |
| S_9149294 \| \| scaffold14851_598958_SNP | 598958 | C | A |
| S_9149375 \| \| scaffold14851_600014_SNP | 600014 | T | A |
| S_9149393 \| \| scaffold14851_600427_SNP | 600427 | T | C |
| S_9149441 \| \| scaffold14851_601403_SNP | 601403 | T | A |
| S_9149465 \| \| scaffold14851_601769_SNP | 601769 | G | C |
| S_9149540 \| \| scaffold14851_602459_SNP | 602459 | T | C |
| S_9149642 \| \| scaffold14851_603900_SNP | 603900 | G | A |
| S_9149643 \| \| scaffold14851_603905_SNP | 603905 | A | C |
| S_9149647 \| \| scaffold14851_603956_SNP | 603956 | A | G |
| S_9149784 \| \| scaffold14851_605886_SNP | 605886 | C | T |
| S_9149785 \| \| scaffold14851_605905_SNP | 605905 | T | C |
| S_9149833 \| \| scaffold14851_606508_SNP | 606508 | G | A |
| S_9149835 \| \| scaffold14851_606534_SNP | 606534 | C | G |
| S_9149901 \| \| scaffold14851_607450_SNP | 607450 | C | A |
| S_9149931 \| \| scaffold14851_607780_SNP | 607780 | C | T |
| S_9149945 \| \| scaffold14851_607911_SNP | 607911 | A | T |
| S_9149953 \| \| scaffold14851_607977_SNP | 607977 | T | A |
| S_9149955 \| \| scaffold14851_607984_SNP | 607984 | G | C |
| S_9149962 \| \| scaffold14851_608067_SNP | 608067 | G | A |
| S_9149964 \| \| scaffold14851_608117_SNP | 608117 | A | G |
| S_9149969 \| \| scaffold14851_608236_SNP | 608236 | T | A |
| S_9149970 \| \| scaffold14851_608241_SNP | 608241 | T | G |
| S_9149988 \| \| scaffold14851_608363_SNP | 608363 | C | G |
| S_9150017 \| \| scaffold14851_608789_SNP | 608789 | G | A |
| S_9150043 \| \| scaffold14851_609309_SNP | 609309 | C | T |
| S_9150129 \| \| scaffold14851_610360_SNP | 610360 | C | A |
| S_9150393 \| \| scaffold14851_614436_SNP | 614436 | A | G |
| S_9150417 \| \| scaffold14851_614893_SNP | 614893 | T | C |
| S_9150493 \| \| scaffold14851_616402_SNP | 616402 | T | C |
| S_9150514 \| \| scaffold14851_616941_SNP | 616941 | G | A |
| S_9150523 \| \| scaffold14851_617133_SNP | 617133 | G | C |
| S_9150572 \| \| scaffold14851_617991_SNP | 617991 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9150590 \| \| scaffold14851_618117_SNP | 618117 | C | T |
| S_9150592 \| \| scaffold14851_618146_SNP | 618146 | G | A |
| S_9150598 \| \| scaffold14851_618198_SNP | 618198 | T | C |
| S_9150769 \| \| scaffold14851_619419_SNP | 619419 | C | A |
| S_9150778 \| \| scaffold14851_619628_SNP | 619628 | T | A |
| S_9150846 \| \| scaffold14851_620594_SNP | 620594 | G | A |
| S_9150913 \| \| scaffold14851_621669_SNP | 621669 | A | C |
| S_9150920 \| \| scaffold14851_621810_SNP | 621810 | G | A |
| S_9150985 \| \| scaffold14851_622670_SNP | 622670 | G | A |
| S_9150990 \| \| scaffold14851_622699_SNP | 622699 | T | C |
| S_9151065 \| \| scaffold14851_623597_SNP | 623597 | T | C |
| scaffold14851_623774_SNP | 623774 | A | G |
| S_9151203 \| \| scaffold14851_625969_SNP | 625969 | C | A |
| S_9151249 \| \| scaffold14851_626502_SNP | 626502 | G | T |
| S_9151250 \| \| scaffold14851_626506_SNP | 626506 | C | T |
| S_9151264 \| \| scaffold14851_626816_SNP | 626816 | T | C |
| S_9151268 \| \| scaffold14851_626876_SNP | 626876 | T | G |
| S_9151270 \| \| scaffold14851_626970_SNP | 626970 | G | T |
| S_9151273 \| \| scaffold14851_627005_SNP | 627005 | C | T |
| S_9151278 \| \| scaffold14851_627059_SNP | 627059 | G | A |
| S_9151288 \| \| scaffold14851_627230_SNP | 627230 | A | T |
| S_9151289 \| \| scaffold14851_627231_SNP | 627231 | G | A |
| S_9151400 \| \| scaffold14851_627867_SNP | 627867 | A | T |
| S_9151472 \| \| scaffold14851_628987_SNP | 628987 | G | A |
| S_9151499 \| \| scaffold14851_629472_SNP | 629472 | A | C |
| S_9151795 \| \| scaffold14851_633959_SNP | 633959 | A | G |
| S_9151813 \| \| scaffold14851_634102_SNP | 634102 | G | C |
| S_9151814 \| \| scaffold14851_634120_SNP | 634120 | C | G |
| S_9152023 \| \| scaffold14851_636210_SNP | 636210 | G | T |
| S_9152058 \| \| scaffold14851_636550_SNP | 636550 | T | C |
| S_9152171 \| \| scaffold14851_638222_SNP | 638222 | T | A |
| S_9152172 \| \| scaffold14851_638226_SNP | 638226 | A | T |
| S_9152174 \| \| scaffold14851_638255_SNP | 638255 | A | T |
| S_9152197 \| \| scaffold14851_638798_SNP | 638798 | G | A |
| scaffold14851_639157_SNP | 639157 | T | A |
| S_9152265 \| \| scaffold14851_639551_SNP | 639551 | T | G |
| S_9152271 \| \| scaffold14851_639728_SNP | 639728 | T | A |
| S_9152280 \| \| scaffold14851_639845_SNP | 639845 | A | T |
| S_9152281 \| \| scaffold14851_639855_SNP | 639855 | A | C |
| S_9152284 \| \| scaffold14851_639966_SNP | 639966 | A | C |
| S_9152286 \| \| scaffold14851_640056_SNP | 640056 | T | G |
| S_9152313 \| \| scaffold14851_640592_SNP | 640592 | T | G |
| S_9152319 \| \| scaffold14851_640667_SNP | 640667 | G | T |
| S_9152320 \| \| scaffold14851_640690_SNP | 640690 | T | A |
| S_9152333 \| \| scaffold14851_640986_SNP | 640986 | C | A |
| S_9152359 \| \| scaffold14851_641291_SNP | 641291 | A | C |
| S_9152364 \| \| scaffold14851_641352_SNP | 641352 | T | C |
| S_9152366 \| \| scaffold14851_641374_SNP | 641374 | G | A |
| S_9152379 \| \| scaffold14851_641556_SNP | 641556 | A | G |
| S_9152381 \| \| scaffold14851_641599_SNP | 641599 | G | T |
| S_9152382 \| \| scaffold14851_641625_SNP | 641625 | C | T |
| S_9152435 \| \| scaffold14851_642454_SNP | 642454 | T | A |
| S_9152465 \| \| scaffold14851_642949_SNP | 642949 | A | G |
| S_9152524 \| \| scaffold14851_643714_SNP | 643714 | G | C |
| S_9152632 \| \| scaffold14851_644716_SNP | 644716 | G | T |
| S_9152713 \| \| scaffold14851_646024_SNP | 646024 | T | A |
| S_9152817 \| \| scaffold14851_647568_SNP | 647568 | C | T |
| S_9152823 \| \| scaffold14851_647673_SNP | 647673 | T | G |
| S_9152889 \| \| scaffold14851_648602_SNP | 648602 | A | T |
| S_9153021 \| \| scaffold14851_649743_SNP | 649743 | T | C |
| S_9153080 \| \| scaffold14851_650540_SNP | 650540 | G | T |
| S_9153081 \| \| scaffold14851_650544_SNP | 650544 | G | T |
| S_9153113 \| \| scaffold14851_651090_SNP | 651090 | T | C |
| S_9153202 \| \| scaffold14851_652368_SNP | 652368 | T | A |
| S_9153256 \| \| scaffold14851_653571_SNP | 653571 | G | T |
| S_9153522 \| \| scaffold14851_657176_SNP | 657176 | T | C |
| S_9153525 \| \| scaffold14851_657239_SNP | 657239 | T | C |
| S_9153527 \| \| scaffold14851_657274_SNP | 657274 | T | G |
| S_9153531 \| \| scaffold14851_657391_SNP | 657391 | T | C |
| S_9153536 \| \| scaffold14851_657426_SNP | 657426 | T | C |
| S_9153538 \| \| scaffold14851_657441_SNP | 657441 | A | T |
| S_9153549 \| \| scaffold14851_657688_SNP | 657688 | C | T |
| S_9153777 \| \| scaffold14851_659622_SNP | 659622 | A | G |
| S_9153807 \| \| scaffold14851_660124_SNP | 660124 | T | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9153842 \| \| scaffold14851_660565_SNP | 660565 | C | T |
| S_9153912 \| \| scaffold14851_660935_SNP | 660935 | A | C |
| S_9153926 \| \| scaffold14851_661173_SNP | 661173 | C | T |
| S_9154018 \| \| scaffold14851_662149_SNP | 662149 | T | C |
| S_9154020 \| \| scaffold14851_662171_SNP | 662171 | G | T |
| S_9154021 \| \| scaffold14851_662173_SNP | 662173 | A | T |
| S_9154046 \| \| scaffold14851_662498_SNP | 662498 | C | T |
| S_9154181 \| \| scaffold14851_663557_SNP | 663557 | A | G |
| S_9154203 \| \| scaffold14851_663867_SNP | 663867 | T | C |
| S_9154237 \| \| scaffold14851_664397_SNP | 664397 | A | T |
| S_9154290 \| \| scaffold14851_670122_SNP | 670122 | G | A |
| S_9154325 \| \| scaffold14851_670619_SNP | 670619 | C | T |
| S_9154359 \| \| scaffold14851_671095_SNP | 671095 | G | A |
| S_9154372 \| \| scaffold14851_671222_SNP | 671222 | G | T |
| S_9154401 \| \| scaffold14851_671638_SNP | 671638 | A | T |
| S_9154447 \| \| scaffold14851_672189_SNP | 672189 | A | G |
| S_9154484 \| \| scaffold14851_673159_SNP | 673159 | C | T |
| S_9154485 \| \| scaffold14851_673160_SNP | 673160 | A | G |
| S_9154488 \| \| scaffold14851_673176_SNP | 673176 | A | G |
| S_9154489 \| \| scaffold14851_673191_SNP | 673191 | C | T |
| S_9154493 \| \| scaffold14851_673251_SNP | 673251 | G | A |
| S_9154698 \| \| scaffold14851_675044_SNP | 675044 | A | C |
| S_9154731 \| \| scaffold14851_675543_SNP | 675543 | C | T |
| S_9154732 \| \| scaffold14851_675551_SNP | 675551 | A | G |
| S_9154748 \| \| scaffold14851_675826_SNP | 675826 | C | G |
| S_9154768 \| \| scaffold14851_676123_SNP | 676123 | A | T |
| S_9154772 \| \| scaffold14851_676232_SNP | 676232 | G | A |
| S_9154774 \| \| scaffold14851_676299_SNP | 676299 | A | G |
| S_9154802 \| \| scaffold14851_676473_SNP | 676473 | A | G |
| S_9154810 \| \| scaffold14851_676483_SNP | 676483 | T | A |
| S_9154814 \| \| scaffold14851_676486_SNP | 676486 | A | G |
| S_9154817 \| \| scaffold14851_676489_SNP | 676489 | A | G |
| S_9154899 \| \| scaffold14851_677667_SNP | 677667 | G | A |
| S_9154934 \| \| scaffold14851_678207_SNP | 678207 | C | T |
| S_9155052 \| \| scaffold14851_679917_SNP | 679917 | A | G |
| S_9155054 \| \| scaffold14851_679925_SNP | 679925 | G | A |
| S_9155055 \| \| scaffold14851_679929_SNP | 679929 | T | C |
| S_9155062 \| \| scaffold14851_679958_SNP | 679958 | A | G |
| S_9155066 \| \| scaffold14851_680039_SNP | 680039 | A | G |
| S_9155068 \| \| scaffold14851_680083_SNP | 680083 | G | A |
| S_9155069 \| \| scaffold14851_680109_SNP | 680109 | C | T |
| S_9155070 \| \| scaffold14851_680139_SNP | 680139 | C | T |
| S_9155071 \| \| scaffold14851_680144_SNP | 680144 | C | T |
| S_9155072 \| \| scaffold14851_680150_SNP | 680150 | A | G |
| S_9155079 \| \| scaffold14851_680352_SNP | 680352 | A | G |
| S_9155081 \| \| scaffold14851_680368_SNP | 680368 | T | G |
| S_9155082 \| \| scaffold14851_680369_SNP | 680369 | A | G |
| S_9155177 \| \| scaffold14851_680981_SNP | 680981 | T | A |
| S_9155179 \| \| scaffold14851_680993_SNP | 680993 | G | A |
| S_9155201 \| \| scaffold14851_681502_SNP | 681502 | C | G |
| S_9155279 \| \| scaffold14851_681925_SNP | 681925 | G | A |
| S_9155341 \| \| scaffold14851_683024_SNP | 683024 | T | G |
| S_9155361 \| \| scaffold14851_683499_SNP | 683499 | C | T |
| S_9155453 \| \| scaffold14851_684338_SNP | 684338 | T | C |
| S_9155603 \| \| scaffold14851_685190_SNP | 685190 | A | G |
| S_9155646 \| \| scaffold14851_685950_SNP | 685950 | C | A |
| S_9155805 \| \| scaffold14851_688163_SNP | 688163 | G | T |
| S_9156025 \| \| scaffold14851_690615_SNP | 690615 | T | A |
| S_9156026 \| \| scaffold14851_690616_SNP | 690616 | T | A |
| S_9156030 \| \| scaffold14851_690704_SNP | 690704 | C | A |
| S_9156052 \| \| scaffold14851_690902_SNP | 690902 | T | C |
| S_9156116 \| \| scaffold14851_691269_SNP | 691269 | G | T |
| S_9156119 \| \| scaffold14851_691446_SNP | 691446 | A | T |
| S_9156122 \| \| scaffold14851_691483_SNP | 691483 | G | T |
| S_9156123 \| \| scaffold14851_691502_SNP | 691502 | C | A |
| S_9156155 \| \| scaffold14851_692183_SNP | 692183 | A | G |
| S_9156253 \| \| scaffold14851_693641_SNP | 693641 | A | T |
| S_9156256 \| \| scaffold14851_693673_SNP | 693673 | A | G |
| S_9156262 \| \| scaffold14851_693792_SNP | 693792 | A | T |
| S_9156266 \| \| scaffold14851_693855_SNP | 693855 | C | T |
| S_9156269 \| \| scaffold14851_693894_SNP | 693894 | C | T |
| S_9156272 \| \| scaffold14851_693934_SNP | 693934 | C | A |
| S_9156351 \| \| scaffold14851_694968_SNP | 694968 | C | T |
| S_9156352 \| \| scaffold14851_694970_SNP | 694970 | G | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9156353 \| \| scaffold14851_695009_SNP | 695009 | A | G |
| S_9156369 \| \| scaffold14851_695232_SNP | 695232 | A | C |
| S_9156375 \| \| scaffold14851_695316_SNP | 695316 | A | C |
| S_9156376 \| \| scaffold14851_695317_SNP | 695317 | C | A |
| S_9156381 \| \| scaffold14851_695378_SNP | 695378 | T | G |
| S_9156392 \| \| scaffold14851_695562_SNP | 695562 | G | C |
| S_9156393 \| \| scaffold14851_695563_SNP | 695563 | T | C |
| S_9156442 \| \| scaffold14851_696228_SNP | 696228 | G | C |
| S_9156534 \| \| scaffold14851_696735_SNP | 696735 | A | G |
| S_9156645 \| \| scaffold14851_697754_SNP | 697754 | A | C |
| S_9156681 \| \| scaffold14851_698090_SNP | 698090 | C | A |
| S_9156682 \| \| scaffold14851_698101_SNP | 698101 | T | G |
| S_9156785 \| \| scaffold14851_699219_SNP | 699219 | G | C |
| S_9157027 \| \| scaffold14851_703488_SNP | 703488 | G | T |
| S_9157029 \| \| scaffold14851_703505_SNP | 703505 | A | T |
| S_9157044 \| \| scaffold14851_703719_SNP | 703719 | T | A |
| S_9157058 \| \| scaffold14851_704005_SNP | 704005 | C | T |
| S_9157101 \| \| scaffold14851_704275_SNP | 704275 | T | C |
| S_9157102 \| \| scaffold14851_704281_SNP | 704281 | G | A |
| scaffold14851_704418_SNP | 704418 | G | A |
| scaffold14851_704423_SNP | 704423 | T | C |
| scaffold14851_704434_SNP | 704434 | C | G |
| S_9157125 \| \| scaffold14851_704458_SNP | 704458 | T | C |
| S_9157147 \| \| scaffold14851_704545_SNP | 704545 | A | C |
| scaffold14851_704824_SNP | 704824 | G | C |
| scaffold14851_704897_SNP | 704897 | C | T |
| S_9157352 \| \| scaffold14851_706992_SNP | 706992 | A | C |
| S_9157359 \| \| scaffold14851_707069_SNP | 707069 | C | T |
| S_9157380 \| \| scaffold14851_707305_SNP | 707305 | A | G |
| S_9157809 \| \| scaffold14851_712878_SNP | 712878 | C | G |
| S_9157843 \| \| scaffold14851_713467_SNP | 713467 | C | A |
| S_9157844 \| \| scaffold14851_713468_SNP | 713468 | A | T |
| S_9158149 \| \| scaffold14851_718205_SNP | 718205 | A | C |
| S_9158165 \| \| scaffold14851_718449_SNP | 718449 | G | A |
| S_9158176 \| \| scaffold14851_718602_SNP | 718602 | C | T |
| S_9158206 \| \| scaffold14851_718982_SNP | 718982 | T | C |
| S_9158207 \| \| scaffold14851_719008_SNP | 719008 | C | A |
| S_9158269 \| \| scaffold14851_719846_SNP | 719846 | A | G |
| S_9158297 \| \| scaffold14851_720384_SNP | 720384 | C | A |
| S_9158312 \| \| scaffold14851_720573_SNP | 720573 | G | A |
| S_9158367 \| \| scaffold14851_721352_SNP | 721352 | T | C |
| S_9158419 \| \| scaffold14851_721949_SNP | 721949 | T | C |
| S_9158456 \| \| scaffold14851_722453_SNP | 722453 | A | G |
| S_9158474 \| \| scaffold14851_722807_SNP | 722807 | G | A |
| S_9158557 \| \| scaffold14851_723843_SNP | 723843 | T | G |
| S_9158745 \| \| scaffold14851_725802_SNP | 725802 | C | T |
| S_9158752 \| \| scaffold14851_725862_SNP | 725862 | A | T |
| S_9158754 \| \| scaffold14851_725927_SNP | 725927 | C | T |
| S_9158760 \| \| scaffold14851_726118_SNP | 726118 | C | A |
| S_9158773 \| \| scaffold14851_726342_SNP | 726342 | A | C |
| S_9158777 \| \| scaffold14851_726479_SNP | 726479 | G | A |
| S_9158809 \| \| scaffold14851_726593_SNP | 726593 | G | C |
| S_9158820 \| \| scaffold14851_726693_SNP | 726693 | G | C |
| S_9158836 \| \| scaffold14851_726842_SNP | 726842 | G | A |
| S_9158840 \| \| scaffold14851_726887_SNP | 726887 | T | C |
| S_9158845 \| \| scaffold14851_726985_SNP | 726985 | T | G |
| S_9158868 \| \| scaffold14851_727063_SNP | 727063 | T | C |
| S_9158900 \| \| scaffold14851_727410_SNP | 727410 | C | T |
| S_9158903 \| \| scaffold14851_727452_SNP | 727452 | A | G |
| S_9159024 \| \| scaffold14851_728794_SNP | 728794 | T | A |
| S_9159378 \| \| scaffold14851_735113_SNP | 735113 | T | C |
| S_9159379 \| \| scaffold14851_735125_SNP | 735125 | G | C |
| S_9159540 \| \| scaffold14851_737442_SNP | 737442 | G | T |
| S_9159771 \| \| scaffold14851_740739_SNP | 740739 | T | A |
| S_9160049 \| \| scaffold14851_743466_SNP | 743466 | C | T |
| S_9160060 \| \| scaffold14851_743629_SNP | 743629 | G | A |
| S_9160067 \| \| scaffold14851_743727_SNP | 743727 | C | G |
| S_9160074 \| \| scaffold14851_743860_SNP | 743860 | G | C |
| S_9160075 \| \| scaffold14851_743865_SNP | 743865 | A | C |
| S_9160080 \| \| scaffold14851_743936_SNP | 743936 | T | G |
| S_9160240 \| \| scaffold14851_746579_SNP | 746579 | T | C |
| S_9160273 \| \| scaffold14851_746880_SNP | 746880 | T | A |
| S_9160303 \| \| scaffold14851_747198_SNP | 747198 | G | A |
| S_9160343 \| \| scaffold14851_747785_SNP | 747785 | C | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9160372 \| \| scaffold14851_748041_SNP | 748041 | C | A |
| S_9160381 \| \| scaffold14851_748137_SNP | 748137 | G | A |
| S_9160407 \| \| scaffold14851_748516_SNP | 748516 | C | T |
| S_9160435 \| \| scaffold14851_748896_SNP | 748896 | G | A |
| S_9160486 \| \| scaffold14851_749525_SNP | 749525 | T | G |
| S_9160498 \| \| scaffold14851_749798_SNP | 749798 | T | C |
| S_9160592 \| \| scaffold14851_750582_SNP | 750582 | T | A |
| S_9160809 \| \| scaffold14851_752508_SNP | 752508 | C | A |
| S_9160909 \| \| scaffold14851_754161_SNP | 754161 | C | T |
| S_9161035 \| \| scaffold14851_755405_SNP | 755405 | T | C |
| S_9161058 \| \| scaffold14851_755692_SNP | 755692 | T | G |
| S_9161210 \| \| scaffold14851_756642_SNP | 756642 | G | A |
| S_9161211 \| \| scaffold14851_756687_SNP | 756687 | T | A |
| S_9161212 \| \| scaffold14851_756755_SNP | 756755 | A | C |
| S_9161218 \| \| scaffold14851_756807_SNP | 756807 | T | C |
| S_9161236 \| \| scaffold14851_757115_SNP | 757115 | C | A |
| S_9161241 \| \| scaffold14851_757263_SNP | 757263 | A | G |
| S_9161243 \| \| scaffold14851_757387_SNP | 757387 | A | G |
| S_9161254 \| \| scaffold14851_757547_SNP | 757547 | G | T |
| S_9161290 \| \| scaffold14851_758245_SNP | 758245 | A | T |
| S_9161311 \| \| scaffold14851_758395_SNP | 758395 | G | A |
| S_9161325 \| \| scaffold14851_758737_SNP | 758737 | C | A |
| S_9161384 \| \| scaffold14851_759448_SNP | 759448 | C | A |
| S_9161505 \| \| scaffold14851_760681_SNP | 760681 | A | G |
| S_9161584 \| \| scaffold14851_761339_SNP | 761339 | T | C |
| S_9161864 \| \| scaffold14851_763327_SNP | 763327 | A | G |
| S_9162113 \| \| scaffold14851_767164_SNP | 767164 | A | G |
| S_9162212 \| \| scaffold14851_768078_SNP | 768078 | A | T |
| S_9162262 \| \| scaffold14851_768897_SNP | 768897 | A | G |
| S_9162270 \| \| scaffold14851_769004_SNP | 769004 | T | C |
| S_9162536 \| \| scaffold14851_771097_SNP | 771097 | G | A |
| S_9162652 \| \| scaffold14851_772833_SNP | 772833 | T | G |
| S_9162654 \| \| scaffold14851_772865_SNP | 772865 | C | T |
| S_9162655 \| \| scaffold14851_772875_SNP | 772875 | C | T |
| S_9162674 \| \| scaffold14851_773072_SNP | 773072 | T | A |
| S_9162675 \| \| scaffold14851_773073_SNP | 773073 | C | T |
| S_9162676 \| \| scaffold14851_773080_SNP | 773080 | A | G |
| S_9162805 \| \| scaffold14851_774271_SNP | 774271 | A | C |
| S_9162808 \| \| scaffold14851_774314_SNP | 774314 | G | A |
| S_9162809 \| \| scaffold14851_774315_SNP | 774315 | G | T |
| S_9162825 \| \| scaffold14851_774508_SNP | 774508 | C | A |
| S_9162827 \| \| scaffold14851_774542_SNP | 774542 | T | A |
| S_9162848 \| \| scaffold14851_774823_SNP | 774823 | A | C |
| S_9162855 \| \| scaffold14851_774966_SNP | 774966 | T | A |
| S_9162908 \| \| scaffold14851_775348_SNP | 775348 | T | C |
| S_9162920 \| \| scaffold14851_775607_SNP | 775607 | T | A |
| S_9162946 \| \| scaffold14851_775828_SNP | 775828 | T | G |
| S_9162964 \| \| scaffold14851_775904_SNP | 775904 | C | T |
| S_9162989 \| \| scaffold14851_776283_SNP | 776283 | G | A |
| S_9163008 \| \| scaffold14851_776562_SNP | 776562 | A | G |
| S_9163225 \| \| scaffold14851_780303_SNP | 780303 | C | G |
| S_9163290 \| \| scaffold14851_781242_SNP | 781242 | C | T |
| S_9163350 \| \| scaffold14851_782315_SNP | 782315 | A | C |
| S_9163361 \| \| scaffold14851_782437_SNP | 782437 | T | A |
| S_9163376 \| \| scaffold14851_782709_SNP | 782709 | G | A |
| S_9163435 \| \| scaffold14851_783249_SNP | 783249 | G | A |
| S_9163437 \| \| scaffold14851_783259_SNP | 783259 | A | G |
| S_9163442 \| \| scaffold14851_783327_SNP | 783327 | A | G |
| S_9163444 \| \| scaffold14851_783350_SNP | 783350 | G | A |
| S_9163524 \| \| scaffold14851_784518_SNP | 784518 | A | G |
| S_9163578 \| \| scaffold14851_785569_SNP | 785569 | C | A |
| S_9163579 \| \| scaffold14851_785605_SNP | 785605 | G | A |
| S_9163590 \| \| scaffold14851_785967_SNP | 785967 | G | A |
| S_9163591 \| \| scaffold14851_785991_SNP | 785991 | G | T |
| S_9163641 \| \| scaffold14851_786585_SNP | 786585 | A | T |
| S_9163664 \| \| scaffold14851_786915_SNP | 786915 | G | C |
| S_9163681 \| \| scaffold14851_787118_SNP | 787118 | C | A |
| S_9163691 \| \| scaffold14851_787258_SNP | 787258 | T | C |
| S_9163694 \| \| scaffold14851_787327_SNP | 787327 | T | G |
| S_9163770 \| \| scaffold14851_788160_SNP | 788160 | C | T |
| S_9163774 \| \| scaffold14851_788210_SNP | 788210 | C | T |
| S_9163782 \| \| scaffold14851_788301_SNP | 788301 | C | T |
| scaffold14851_788826_SNP | 788826 | A | G |
| scaffold14851_788838_SNP | 788838 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9163849 \| \| scaffold14851_788975_SNP | 788975 | G | C |
| S_9163888 \| \| scaffold14851_789482_SNP | 789482 | G | A |
| S_9163890 \| \| scaffold14851_789489_SNP | 789489 | A | T |
| S_9163896 \| \| scaffold14851_789782_SNP | 789782 | C | T |
| S_9163897 \| \| scaffold14851_789783_SNP | 789783 | C | A |
| S_9164021 \| \| scaffold14851_792053_SNP | 792053 | A | G |
| S_9164049 \| \| scaffold14851_792387_SNP | 792387 | T | C |
| S_9164057 \| \| scaffold14851_792505_SNP | 792505 | T | G |
| S_9164086 \| \| scaffold14851_793039_SNP | 793039 | A | G |
| S_9164096 \| \| scaffold14851_793274_SNP | 793274 | G | C |
| S_9164097 \| \| scaffold14851_793342_SNP | 793342 | G | T |
| S_9164148 \| \| scaffold14851_794049_SNP | 794049 | T | C |
| S_9164212 \| \| scaffold14851_794583_SNP | 794583 | G | T |
| S_9164235 \| \| scaffold14851_794903_SNP | 794903 | G | A |
| S_9164236 \| \| scaffold14851_794904_SNP | 794904 | A | T |
| S_9164239 \| \| scaffold14851_794925_SNP | 794925 | T | C |
| S_9164273 \| \| scaffold14851_795283_SNP | 795283 | G | A |
| S_9164299 \| \| scaffold14851_795948_SNP | 795948 | G | T |
| S_9164414 \| \| scaffold14851_797655_SNP | 797655 | G | C |
| S_9164427 \| \| scaffold14851_797824_SNP | 797824 | A | C |
| S_9164429 \| \| scaffold14851_797836_SNP | 797836 | C | G |
| S_9164430 \| \| scaffold14851_797868_SNP | 797868 | G | A |
| S_9164449 \| \| scaffold14851_798130_SNP | 798130 | C | T |
| scaffold14851_801198_SNP | 801198 | T | A |
| S_9164802 \| \| scaffold14851_801205_SNP | 801205 | G | A |
| S_9165057 \| \| scaffold14851_803670_SNP | 803670 | A | G |
| S_9165058 \| \| scaffold14851_803671_SNP | 803671 | A | C |
| S_9165059 \| \| scaffold14851_803672_SNP | 803672 | G | C |
| S_9165364 \| \| scaffold14851_806344_SNP | 806344 | T | C |
| S_9165365 \| \| scaffold14851_806356_SNP | 806356 | A | T |
| S_9165385 \| \| scaffold14851_806533_SNP | 806533 | G | A |
| S_9167225 \| \| scaffold14851_824740_SNP | 824740 | C | T |
| S_9167975 \| \| scaffold14851_830032_SNP | 830032 | A | G |
| S_9168018 \| \| scaffold14851_830741_SNP | 830741 | T | C |
| S_9168019 \| \| scaffold14851_830749_SNP | 830749 | A | G |
| S_9168023 \| \| scaffold14851_830781_SNP | 830781 | T | C |
| S_9168074 \| \| scaffold14851_831587_SNP | 831587 | C | A |
| S_9168079 \| \| scaffold14851_831638_SNP | 831638 | G | A |
| S_9168242 \| \| scaffold14851_834096_SNP | 834096 | C | T |
| S_9168677 \| \| scaffold14851_836479_SNP | 836479 | G | C |
| S_9169339 \| \| scaffold14851_842490_SNP | 842490 | C | T |
| S_9169340 \| \| scaffold14851_842577_SNP | 842577 | C | T |
| S_9169342 \| \| scaffold14851_842611_SNP | 842611 | T | A |
| S_9169367 \| \| scaffold14851_842861_SNP | 842861 | C | A |
| S_9169407 \| \| scaffold14851_843314_SNP | 843314 | T | A |
| S_9169411 \| \| scaffold14851_843390_SNP | 843390 | C | G |
| scaffold14851_843765_SNP | 843765 | C | G |
| S_9171625 \| \| scaffold14851_858825_SNP | 858825 | T | C |
| S_9171694 \| \| scaffold14851_859657_SNP | 859657 | G | A |
| S_9171716 \| \| scaffold14851_859847_SNP | 859847 | C | T |
| S_9171815 \| \| scaffold14851_860664_SNP | 860664 | T | G |
| S_9172261 \| \| scaffold14851_864073_SNP | 864073 | G | A |
| S_9175599 \| \| scaffold14851_892750_SNP | 892750 | C | T |
| S_9176716 \| \| scaffold14851_905079_SNP | 905079 | A | G |
| S_9177569 \| \| scaffold14851_915675_SNP | 915675 | A | T |
| scaffold14851_915679_SNP | 915679 | G | A |
| S_9179270 \| \| scaffold14851_931527_SNP | 931527 | C | A |
| S_9179493 \| \| scaffold14851_934643_SNP | 934643 | A | T |
| S_9179513 \| \| scaffold14851_934925_SNP | 934925 | C | T |
| S_9180028 \| \| scaffold14851_940662_SNP | 940662 | C | T |
| scaffold14851_954099_SNP | 954099 | G | A |
| S_9180584 \| \| scaffold14851_954424_SNP | 954424 | C | T |
| S_9181469 \| \| scaffold14851_965459_SNP | 965459 | A | G |
| scaffold14851_965621_SNP | 965621 | G | C |
| S_9181488 \| \| scaffold14851_965626_SNP | 965626 | G | T |
| S_9181737 \| \| scaffold14851_969364_SNP | 969364 | T | C |
| S_9185658 \| \| scaffold14851_996202_SNP | 996202 | C | T |
| S_9185659 \| \| scaffold14851_996206_SNP | 996206 | A | G |
| S_9185698 \| \| scaffold14851_997055_SNP | 997055 | G | A |
| S_9185700 \| \| scaffold14851_997074_SNP | 997074 | A | G |
| S_9185847 \| \| scaffold14851_998830_SNP | 998830 | A | C |
| S_9185899 \| \| scaffold14851_999634_SNP | 999634 | G | T |
| S_9185932 \| \| scaffold14851_1000178_SNP | 1000178 | G | T |
| scaffold14851_1011547_SNP | 1011547 | T | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| scaffold14851_1011548_SNP | 1011548 | T | G |
| S_9190670 \| \| scaffold14851_1011554_SNP | 1011554 | T | G |
| S_9190671 \| \| scaffold14851_1011558_SNP | 1011558 | T | A |
| S_9190928 \| \| scaffold14851_1014512_SNP | 1014512 | T | A |
| S_9190929 \| \| scaffold14851_1014518_SNP | 1014518 | T | G |
| S_9190976 \| \| scaffold14851_1015253_SNP | 1015253 | C | T |
| S_9191042 \| \| scaffold14851_1016117_SNP | 1016117 | A | T |
| S_9191046 \| \| scaffold14851_1016186_SNP | 1016186 | T | A |
| S_9191048 \| \| scaffold14851_1016219_SNP | 1016219 | G | A |
| S_9191086 \| \| scaffold14851_1017283_SNP | 1017283 | T | A |
| S_9191230 \| \| scaffold14851_1018995_SNP | 1018995 | C | A |
| S_9191233 \| \| scaffold14851_1019005_SNP | 1019005 | T | G |
| S_9191234 \| \| scaffold14851_1019008_SNP | 1019008 | T | G |
| S_9191257 \| \| scaffold14851_1019557_SNP | 1019557 | A | G |
| S_9191259 \| \| scaffold14851_1019578_SNP | 1019578 | C | A |
| S_9191262 \| \| scaffold14851_1019633_SNP | 1019633 | A | G |
| S_9191263 \| \| scaffold14851_1019646_SNP | 1019646 | C | T |
| S_9191385 \| \| scaffold14851_1020806_SNP | 1020806 | A | G |
| S_9191609 \| \| scaffold14851_1023684_SNP | 1023684 | A | G |
| S_9191611 \| \| scaffold14851_1023725_SNP | 1023725 | A | G |
| S_9192020 \| \| scaffold14851_1030502_SNP | 1030502 | C | T |
| S_9192311 \| \| scaffold14851_1036589_SNP | 1036589 | C | T |
| S_9192317 \| \| scaffold14851_1036761_SNP | 1036761 | T | C |
| S_9192321 \| \| scaffold14851_1036939_SNP | 1036939 | C | A |
| S_9192336 \| \| scaffold14851_1037109_SNP | 1037109 | A | G |
| S_9192339 \| \| scaffold14851_1037167_SNP | 1037167 | A | G |
| S_9192455 \| \| scaffold14851_1038752_SNP | 1038752 | G | T |
| S_9192493 \| \| scaffold14851_1039411_SNP | 1039411 | A | G |
| S_9192494 \| \| scaffold14851_1039427_SNP | 1039427 | G | C |
| S_9192663 \| \| scaffold14851_1041651_SNP | 1041651 | G | A |
| S_9192694 \| \| scaffold14851_1042229_SNP | 1042229 | C | A |
| S_9192737 \| \| scaffold14851_1043155_SNP | 1043155 | C | G |
| S_9192738 \| \| scaffold14851_1043160_SNP | 1043160 | G | T |
| S_9192739 \| \| scaffold14851_1043220_SNP | 1043220 | C | A |
| S_9192741 \| \| scaffold14851_1043226_SNP | 1043226 | G | T |
| S_9192749 \| \| scaffold14851_1043337_SNP | 1043337 | A | G |
| S_9192794 \| \| scaffold14851_1043561_SNP | 1043561 | G | T |
| S_9193313 \| \| scaffold14851_1049711_SNP | 1049711 | G | A |
| S_9193486 \| \| scaffold14851_1052442_SNP | 1052442 | C | G |
| S_9193514 \| \| scaffold14851_1052776_SNP | 1052776 | G | C |
| S_9193535 \| \| scaffold14851_1053009_SNP | 1053009 | T | A |
| S_9193536 \| \| scaffold14851_1053013_SNP | 1053013 | G | T |
| S_9193543 \| \| scaffold14851_1053083_SNP | 1053083 | C | G |
| S_9193544 \| \| scaffold14851_1053092_SNP | 1053092 | T | A |
| S_9193545 \| \| scaffold14851_1053106_SNP | 1053106 | T | A |
| S_9193551 \| \| scaffold14851_1053192_SNP | 1053192 | C | A |
| S_9193555 \| \| scaffold14851_1053228_SNP | 1053228 | T | A |
| S_9193658 \| \| scaffold14851_1054986_SNP | 1054986 | G | T |
| S_9193684 \| \| scaffold14851_1055854_SNP | 1055854 | T | C |
| S_9193702 \| \| scaffold14851_1056116_SNP | 1056116 | A | G |
| S_9193706 \| \| scaffold14851_1056236_SNP | 1056236 | T | A |
| S_9193746 \| \| scaffold14851_1056630_SNP | 1056630 | A | G |
| S_9193865 \| \| scaffold14851_1058208_SNP | 1058208 | T | C |
| S_9194606 \| \| scaffold14851_1067404_SNP | 1067404 | T | A |
| S_9194706 \| \| scaffold14851_1068807_SNP | 1068807 | A | C |
| S_9194708 \| \| scaffold14851_1068832_SNP | 1068832 | C | A |
| S_9194720 \| \| scaffold14851_1069093_SNP | 1069093 | T | G |
| S_9194721 \| \| scaffold14851_1069118_SNP | 1069118 | A | T |
| S_9194722 \| \| scaffold14851_1069122_SNP | 1069122 | T | A |
| S_9194723 \| \| scaffold14851_1069168_SNP | 1069168 | A | C |
| S_9194730 \| \| scaffold14851_1069349_SNP | 1069349 | G | T |
| S_9194913 \| \| scaffold14851_1072101_SNP | 1072101 | C | T |
| S_9194926 \| \| scaffold14851_1072306_SNP | 1072306 | T | G |
| S_9194970 \| \| scaffold14851_1072503_SNP | 1072503 | T | C |
| S_9195108 \| \| scaffold14851_1073728_SNP | 1073728 | C | T |
| S_9195180 \| \| scaffold14851_1074610_SNP | 1074610 | A | T |
| S_9195213 \| \| scaffold14851_1075177_SNP | 1075177 | T | C |
| S_9195249 \| \| scaffold14851_1075746_SNP | 1075746 | T | A |
| S_9195292 \| \| scaffold14851_1075913_SNP | 1075913 | C | T |
| S_9195303 \| \| scaffold14851_1076002_SNP | 1076002 | G | A |
| S_9195357 \| \| scaffold14851_1076695_SNP | 1076695 | G | T |
| S_9195362 \| \| scaffold14851_1076792_SNP | 1076792 | A | G |
| S_9195366 \| \| scaffold14851_1076820_SNP | 1076820 | A | G |
| S_9195368 \| \| scaffold14851_1076842_SNP | 1076842 | C | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9195370 \|\| scaffold14851_1076850_SNP | 1076850 | A | G |
| S_9195371 \|\| scaffold14851_1076879_SNP | 1076879 | A | G |
| S_9195435 \|\| scaffold14851_1078084_SNP | 1078084 | G | A |
| S_9195546 \|\| scaffold14851_1079943_SNP | 1079943 | G | A |
| S_9195550 \|\| scaffold14851_1080058_SNP | 1080058 | C | T |
| S_9195552 \|\| scaffold14851_1080091_SNP | 1080091 | T | G |
| S_9195554 \|\| scaffold14851_1080111_SNP | 1080111 | A | C |
| S_9195574 \|\| scaffold14851_1080367_SNP | 1080367 | C | T |
| S_9195578 \|\| scaffold14851_1080389_SNP | 1080389 | C | T |
| S_9195579 \|\| scaffold14851_1080405_SNP | 1080405 | G | C |
| S_9195584 \|\| scaffold14851_1080511_SNP | 1080511 | G | A |
| S_9195640 \|\| scaffold14851_1081289_SNP | 1081289 | A | C |
| S_9195664 \|\| scaffold14851_1081751_SNP | 1081751 | G | A |
| S_9195668 \|\| scaffold14851_1081913_SNP | 1081913 | C | T |
| S_9195682 \|\| scaffold14851_1082198_SNP | 1082198 | A | G |
| S_9195759 \|\| scaffold14851_1082895_SNP | 1082895 | T | C |
| S_9195775 \|\| scaffold14851_1083013_SNP | 1083013 | T | C |
| S_9195965 \|\| scaffold14851_1085185_SNP | 1085185 | G | T |
| S_9196240 \|\| scaffold14851_1089739_SNP | 1089739 | G | A |
| S_9196242 \|\| scaffold14851_1089748_SNP | 1089748 | T | C |
| S_9196249 \|\| scaffold14851_1089852_SNP | 1089852 | C | G |
| S_9196256 \|\| scaffold14851_1089939_SNP | 1089939 | T | A |
| S_9196258 \|\| scaffold14851_1089958_SNP | 1089958 | C | T |
| scaffold14851_1091765_SNP | 1091765 | A | G |
| S_9196517 \|\| scaffold14851_1092396_SNP | 1092396 | A | C |
| S_9196532 \|\| scaffold14851_1092527_SNP | 1092527 | T | C |
| S_9196533 \|\| scaffold14851_1092555_SNP | 1092555 | G | A |
| S_9196545 \|\| scaffold14851_1092675_SNP | 1092675 | T | C |
| S_9196561 \|\| scaffold14851_1092838_SNP | 1092838 | G | T |
| S_9196590 \|\| scaffold14851_1093305_SNP | 1093305 | A | G |
| S_9196595 \|\| scaffold14851_1093367_SNP | 1093367 | G | A |
| S_9196598 \|\| scaffold14851_1093465_SNP | 1093465 | C | T |
| S_9196603 \|\| scaffold14851_1093519_SNP | 1093519 | A | G |
| S_9196604 \|\| scaffold14851_1093541_SNP | 1093541 | T | C |
| S_9196611 \|\| scaffold14851_1093695_SNP | 1093695 | T | C |
| S_9196619 \|\| scaffold14851_1093878_SNP | 1093878 | A | G |
| S_9196633 \|\| scaffold14851_1094081_SNP | 1094081 | T | G |
| S_9196647 \|\| scaffold14851_1094296_SNP | 1094296 | A | T |
| S_9196656 \|\| scaffold14851_1094426_SNP | 1094426 | A | G |
| S_9196657 \|\| scaffold14851_1094461_SNP | 1094461 | G | A |
| S_9196962 \|\| scaffold14851_1098075_SNP | 1098075 | A | T |
| S_9197251 \|\| scaffold14851_1102315_SNP | 1102315 | C | G |
| S_9197389 \|\| scaffold14851_1104823_SNP | 1104823 | G | A |
| S_9197453 \|\| scaffold14851_1105851_SNP | 1105851 | G | T |
| S_9197462 \|\| scaffold14851_1106068_SNP | 1106068 | G | A |
| S_9197509 \|\| scaffold14851_1106855_SNP | 1106855 | C | T |
| S_9197554 \|\| scaffold14851_1107383_SNP | 1107383 | A | G |
| S_9197556 \|\| scaffold14851_1107397_SNP | 1107397 | A | G |
| S_9197561 \|\| scaffold14851_1107507_SNP | 1107507 | T | C |
| S_9197566 \|\| scaffold14851_1107635_SNP | 1107635 | A | C |
| S_9197602 \|\| scaffold14851_1108152_SNP | 1108152 | A | T |
| S_9197614 \|\| scaffold14851_1108266_SNP | 1108266 | G | A |
| S_9197679 \|\| scaffold14851_1109181_SNP | 1109181 | C | T |
| S_9197736 \|\| scaffold14851_1110040_SNP | 1110040 | C | T |
| S_9197737 \|\| scaffold14851_1110044_SNP | 1110044 | C | T |
| S_9197741 \|\| scaffold14851_1110122_SNP | 1110122 | A | G |
| S_9197742 \|\| scaffold14851_1110129_SNP | 1110129 | A | G |
| S_9197750 \|\| scaffold14851_1110236_SNP | 1110236 | C | T |
| S_9197761 \|\| scaffold14851_1110351_SNP | 1110351 | C | T |
| S_9197806 \|\| scaffold14851_1111128_SNP | 1111128 | C | T |
| S_9197820 \|\| scaffold14851_1111301_SNP | 1111301 | T | C |
| S_9197830 \|\| scaffold14851_1111410_SNP | 1111410 | A | G |
| S_9197862 \|\| scaffold14851_1111637_SNP | 1111637 | C | A |
| S_9197865 \|\| scaffold14851_1111687_SNP | 1111687 | G | T |
| S_9197866 \|\| scaffold14851_1111705_SNP | 1111705 | G | A |
| S_9197882 \|\| scaffold14851_1112129_SNP | 1112129 | A | G |
| S_9197883 \|\| scaffold14851_1112135_SNP | 1112135 | G | T |
| S_9197900 \|\| scaffold14851_1112362_SNP | 1112362 | T | C |
| S_9197901 \|\| scaffold14851_1112367_SNP | 1112367 | A | G |
| S_9197903 \|\| scaffold14851_1112396_SNP | 1112396 | C | T |
| S_9197904 \|\| scaffold14851_1112418_SNP | 1112418 | T | C |
| S_9197914 \|\| scaffold14851_1112537_SNP | 1112537 | A | T |
| S_9197924 \|\| scaffold14851_1112762_SNP | 1112762 | G | T |
| S_9197926 \|\| scaffold14851_1112778_SNP | 1112778 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9197989 \| \| scaffold14851_1113318_SNP | 1113318 | A | G |
| S_9197992 \| \| scaffold14851_1113365_SNP | 1113365 | C | A |
| S_9198006 \| \| scaffold14851_1113685_SNP | 1113685 | T | C |
| S_9198021 \| \| scaffold14851_1113890_SNP | 1113890 | C | G |
| S_9198022 \| \| scaffold14851_1113905_SNP | 1113905 | G | T |
| S_9198027 \| \| scaffold14851_1113973_SNP | 1113973 | T | A |
| S_9198034 \| \| scaffold14851_1114083_SNP | 1114083 | G | A |
| S_9198048 \| \| scaffold14851_1114212_SNP | 1114212 | T | C |
| S_9198060 \| \| scaffold14851_1114354_SNP | 1114354 | G | C |
| S_9198073 \| \| scaffold14851_1114577_SNP | 1114577 | A | T |
| S_9198074 \| \| scaffold14851_1114579_SNP | 1114579 | T | G |
| S_9198075 \| \| scaffold14851_1114606_SNP | 1114606 | A | G |
| S_9198081 \| \| scaffold14851_1114670_SNP | 1114670 | T | C |
| S_9198083 \| \| scaffold14851_1114683_SNP | 1114683 | C | T |
| S_9198117 \| \| scaffold14851_1115264_SNP | 1115264 | G | A |
| S_9198165 \| \| scaffold14851_1115710_SNP | 1115710 | T | G |
| S_9198175 \| \| scaffold14851_1115766_SNP | 1115766 | G | T |
| S_9198270 \| \| scaffold14851_1117306_SNP | 1117306 | T | A |
| S_9198274 \| \| scaffold14851_1117339_SNP | 1117339 | C | A |
| S_9198325 \| \| scaffold14851_1118002_SNP | 1118002 | C | T |
| S_9198350 \| \| scaffold14851_1118349_SNP | 1118349 | C | G |
| S_9198647 \| \| scaffold14851_1123215_SNP | 1123215 | T | C |
| S_9198690 \| \| scaffold14851_1124110_SNP | 1124110 | T | A |
| S_9198739 \| \| scaffold14851_1125069_SNP | 1125069 | T | C |
| S_9198742 \| \| scaffold14851_1125140_SNP | 1125140 | C | A |
| S_9198745 \| \| scaffold14851_1125186_SNP | 1125186 | C | T |
| S_9198747 \| \| scaffold14851_1125196_SNP | 1125196 | C | T |
| S_9198770 \| \| scaffold14851_1125390_SNP | 1125390 | T | A |
| S_9198832 \| \| scaffold14851_1126309_SNP | 1126309 | C | T |
| S_9199099 \| \| scaffold14851_1130920_SNP | 1130920 | A | G |
| S_9199138 \| \| scaffold14851_1131501_SNP | 1131501 | T | C |
| S_9199173 \| \| scaffold14851_1132052_SNP | 1132052 | A | G |
| S_9199225 \| \| scaffold14851_1134075_SNP | 1134075 | A | T |
| S_9199293 \| \| scaffold14851_1135883_SNP | 1135883 | A | T |
| S_9199320 \| \| scaffold14851_1136275_SNP | 1136275 | T | C |
| S_9199370 \| \| scaffold14851_1136800_SNP | 1136800 | G | A |
| S_9199895 \| \| scaffold14851_1142182_SNP | 1142182 | G | A |
| S_9199896 \| \| scaffold14851_1142204_SNP | 1142204 | C | G |
| S_9199897 \| \| scaffold14851_1142218_SNP | 1142218 | C | G |
| S_9200445 \| \| scaffold14851_1146799_SNP | 1146799 | T | C |
| S_9200448 \| \| scaffold14851_1146811_SNP | 1146811 | C | G |
| S_9200478 \| \| scaffold14851_1147028_SNP | 1147028 | C | A |
| S_9200559 \| \| scaffold14851_1148194_SNP | 1148194 | A | T |
| S_9200697 \| \| scaffold14851_1148656_SNP | 1148656 | T | G |
| S_9200827 \| \| scaffold14851_1149245_SNP | 1149245 | T | C |
| scaffold14851_1151185_SNP | 1151185 | T | C |
| scaffold14851_1153152_SNP | 1153152 | T | G |
| S_9201895 \| \| scaffold14851_1153622_SNP | 1153622 | G | T |
| S_9201899 \| \| scaffold14851_1153639_SNP | 1153639 | T | A |
| S_9201926 \| \| scaffold14851_1153766_SNP | 1153766 | A | T |
| S_9201955 \| \| scaffold14851_1153896_SNP | 1153896 | A | G |
| S_9208205 \| \| scaffold14851_1173113_SNP | 1173113 | A | C |
| scaffold14851_1173267_SNP | 1173267 | A | G |
| S_9209058 \| \| scaffold14851_1179184_SNP | 1179184 | T | A |
| S_9209156 \| \| scaffold14851_1179507_SNP | 1179507 | A | G |
| S_9209159 \| \| scaffold14851_1179541_SNP | 1179541 | G | A |
| S_9209162 \| \| scaffold14851_1179561_SNP | 1179561 | A | G |
| S_9210444 \| \| scaffold14851_1186275_SNP | 1186275 | T | G |
| S_9210573 \| \| scaffold14851_1186740_SNP | 1186740 | A | T |
| S_9210609 \| \| scaffold14851_1186872_SNP | 1186872 | T | C |
| S_9210618 \| \| scaffold14851_1186932_SNP | 1186932 | T | A |
| S_9210621 \| \| scaffold14851_1186975_SNP | 1186975 | A | G |
| scaffold14851_1187445_SNP | 1187445 | T | A |
| S_9210893 \| \| scaffold14851_1187869_SNP | 1187869 | T | C |
| S_9210930 \| \| scaffold14851_1188108_SNP | 1188108 | A | G |
| S_9210931 \| \| scaffold14851_1188109_SNP | 1188109 | A | G |
| S_9210947 \| \| scaffold14851_1188216_SNP | 1188216 | T | C |
| S_9210949 \| \| scaffold14851_1188239_SNP | 1188239 | A | C |
| S_9210963 \| \| scaffold14851_1188358_SNP | 1188358 | C | A |
| S_9210964 \| \| scaffold14851_1188368_SNP | 1188368 | A | G |
| S_9210965 \| \| scaffold14851_1188369_SNP | 1188369 | A | T |
| S_9211586 \| \| scaffold14851_1189820_SNP | 1189820 | G | T |
| S_9211625 \| \| scaffold14851_1190038_SNP | 1190038 | G | A |
| S_9211628 \| \| scaffold14851_1190045_SNP | 1190045 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9211925 \| \| scaffold14851_1191719_SNP | 1191719 | G | A |
| S_9212158 \| \| scaffold14851_1192272_SNP | 1192272 | T | G |
| S_9212217 \| \| scaffold14851_1192576_SNP | 1192576 | C | T |
| scaffold14851_1192712_SNP | 1192712 | A | C |
| S_9212239 \| \| scaffold14851_1192716_SNP | 1192716 | C | T |
| S_9212308 \| \| scaffold14851_1194480_SNP | 1194480 | C | T |
| S_9212370 \| \| scaffold14851_1194966_SNP | 1194966 | C | T |
| S_9212374 \| \| scaffold14851_1195056_SNP | 1195056 | A | G |
| scaffold14851_1195080_SNP | 1195080 | C | T |
| scaffold14851_1195095_SNP | 1195095 | C | A |
| S_9212391 \| \| scaffold14851_1195194_SNP | 1195194 | C | T |
| S_9212394 \| \| scaffold14851_1195208_SNP | 1195208 | C | A |
| S_9212491 \| \| scaffold14851_1196481_SNP | 1196481 | G | T |
| S_9212643 \| \| scaffold14851_1198088_SNP | 1198088 | A | T |
| S_9212644 \| \| scaffold14851_1198094_SNP | 1198094 | G | A |
| S_9212648 \| \| scaffold14851_1198166_SNP | 1198166 | A | C |
| S_9212782 \| \| scaffold14851_1198881_SNP | 1198881 | G | A |
| S_9212785 \| \| scaffold14851_1198946_SNP | 1198946 | T | C |
| S_9213927 \| \| scaffold14851_1203232_SNP | 1203232 | A | G |
| S_9213960 \| \| scaffold14851_1203591_SNP | 1203591 | G | C |
| S_9213962 \| \| scaffold14851_1203600_SNP | 1203600 | A | G |
| S_9213996 \| \| scaffold14851_1204080_SNP | 1204080 | A | G |
| S_9213997 \| \| scaffold14851_1204087_SNP | 1204087 | C | T |
| S_9214005 \| \| scaffold14851_1204279_SNP | 1204279 | C | A |
| S_9214006 \| \| scaffold14851_1204280_SNP | 1204280 | C | A |
| S_9214056 \| \| scaffold14851_1204969_SNP | 1204969 | A | T |
| S_9214076 \| \| scaffold14851_1205205_SNP | 1205205 | C | G |
| scaffold14851_1205522_SNP | 1205522 | A | T |
| S_9214138 \| \| scaffold14851_1205824_SNP | 1205824 | A | G |
| S_9214141 \| \| scaffold14851_1205902_SNP | 1205902 | T | G |
| S_9214142 \| \| scaffold14851_1205903_SNP | 1205903 | G | T |
| S_9214169 \| \| scaffold14851_1206504_SNP | 1206504 | T | C |
| S_9214192 \| \| scaffold14851_1206821_SNP | 1206821 | T | C |
| S_9214193 \| \| scaffold14851_1206822_SNP | 1206822 | G | A |
| S_9214195 \| \| scaffold14851_1206858_SNP | 1206858 | G | A |
| S_9214211 \| \| scaffold14851_1207277_SNP | 1207277 | C | G |
| S_9214243 \| \| scaffold14851_1207642_SNP | 1207642 | A | G |
| S_9214244 \| \| scaffold14851_1207648_SNP | 1207648 | T | C |
| S_9214261 \| \| scaffold14851_1207902_SNP | 1207902 | G | A |
| S_9214265 \| \| scaffold14851_1207971_SNP | 1207971 | A | T |
| S_9214266 \| \| scaffold14851_1207991_SNP | 1207991 | G | T |
| S_9214275 \| \| scaffold14851_1208169_SNP | 1208169 | A | C |
| S_9214277 \| \| scaffold14851_1208204_SNP | 1208204 | A | C |
| S_9214280 \| \| scaffold14851_1208228_SNP | 1208228 | C | T |
| S_9214283 \| \| scaffold14851_1208298_SNP | 1208298 | C | A |
| S_9214410 \| \| scaffold14851_1209871_SNP | 1209871 | C | T |
| S_9214444 \| \| scaffold14851_1210239_SNP | 1210239 | G | T |
| scaffold14851_1211484_SNP | 1211484 | T | C |
| S_9214559 \| \| scaffold14851_1211758_SNP | 1211758 | C | T |
| S_9214560 \| \| scaffold14851_1211764_SNP | 1211764 | A | T |
| S_9214579 \| \| scaffold14851_1211986_SNP | 1211986 | A | C |
| S_9214583 \| \| scaffold14851_1212028_SNP | 1212028 | G | A |
| S_9214584 \| \| scaffold14851_1212036_SNP | 1212036 | C | T |
| S_9214590 \| \| scaffold14851_1212163_SNP | 1212163 | G | A |
| S_9214613 \| \| scaffold14851_1212345_SNP | 1212345 | A | C |
| S_9214620 \| \| scaffold14851_1212426_SNP | 1212426 | C | A |
| S_9214672 \| \| scaffold14851_1213012_SNP | 1213012 | T | G |
| S_9214673 \| \| scaffold14851_1213026_SNP | 1213026 | G | A |
| S_9214743 \| \| scaffold14851_1213836_SNP | 1213836 | A | C |
| S_9214745 \| \| scaffold14851_1213849_SNP | 1213849 | C | A |
| S_9214747 \| \| scaffold14851_1213861_SNP | 1213861 | T | A |
| S_9214748 \| \| scaffold14851_1213871_SNP | 1213871 | C | A |
| S_9214782 \| \| scaffold14851_1214565_SNP | 1214565 | T | C |
| S_9214783 \| \| scaffold14851_1214578_SNP | 1214578 | G | A |
| S_9214784 \| \| scaffold14851_1214582_SNP | 1214582 | C | T |
| S_9214798 \| \| scaffold14851_1214769_SNP | 1214769 | G | A |
| S_9214805 \| \| scaffold14851_1214811_SNP | 1214811 | C | T |
| S_9214823 \| \| scaffold14851_1214915_SNP | 1214915 | T | C |
| S_9214843 \| \| scaffold14851_1215349_SNP | 1215349 | A | G |
| S_9214844 \| \| scaffold14851_1215360_SNP | 1215360 | T | C |
| S_9214846 \| \| scaffold14851_1215386_SNP | 1215386 | C | T |
| S_9214851 \| \| scaffold14851_1215442_SNP | 1215442 | A | T |
| S_9214852 \| \| scaffold14851_1215447_SNP | 1215447 | G | A |
| S_9214853 \| \| scaffold14851_1215449_SNP | 1215449 | G | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9215276 \| \| scaffold14851_1217283_SNP | 1217283 | T | A |
| S_9215277 \| \| scaffold14851_1217327_SNP | 1217327 | C | T |
| S_9215279 \| \| scaffold14851_1217346_SNP | 1217346 | A | T |
| S_9215280 \| \| scaffold14851_1217359_SNP | 1217359 | A | G |
| S_9215282 \| \| scaffold14851_1217440_SNP | 1217440 | A | G |
| S_9215348 \| \| scaffold14851_1219322_SNP | 1219322 | A | T |
| S_9215398 \| \| scaffold14851_1220185_SNP | 1220185 | G | A |
| S_9215404 \| \| scaffold14851_1220280_SNP | 1220280 | T | C |
| S_9215407 \| \| scaffold14851_1220366_SNP | 1220366 | G | C |
| S_9215415 \| \| scaffold14851_1220493_SNP | 1220493 | T | A |
| S_9215431 \| \| scaffold14851_1220656_SNP | 1220656 | C | T |
| S_9215436 \| \| scaffold14851_1220687_SNP | 1220687 | G | A |
| S_9215450 \| \| scaffold14851_1220948_SNP | 1220948 | G | A |
| S_9215451 \| \| scaffold14851_1220949_SNP | 1220949 | A | T |
| S_9215459 \| \| scaffold14851_1221030_SNP | 1221030 | C | A |
| S_9215460 \| \| scaffold14851_1221042_SNP | 1221042 | C | T |
| S_9215462 \| \| scaffold14851_1221059_SNP | 1221059 | G | A |
| S_9215494 \| \| scaffold14851_1221598_SNP | 1221598 | A | C |
| S_9215533 \| \| scaffold14851_1221851_SNP | 1221851 | A | T |
| S_9215534 \| \| scaffold14851_1221860_SNP | 1221860 | G | A |
| S_9215584 \| \| scaffold14851_1222952_SNP | 1222952 | G | A |
| S_9215609 \| \| scaffold14851_1223332_SNP | 1223332 | C | T |
| S_9215614 \| \| scaffold14851_1223400_SNP | 1223400 | A | C |
| S_9215620 \| \| scaffold14851_1223415_SNP | 1223415 | A | T |
| S_9215632 \| \| scaffold14851_1223483_SNP | 1223483 | A | G |
| S_9215654 \| \| scaffold14851_1223575_SNP | 1223575 | T | C |
| S_9215657 \| \| scaffold14851_1223592_SNP | 1223592 | C | G |
| S_9215698 \| \| scaffold14851_1223831_SNP | 1223831 | C | T |
| S_9215699 \| \| scaffold14851_1223852_SNP | 1223852 | T | C |
| S_9215700 \| \| scaffold14851_1223860_SNP | 1223860 | A | C |
| S_9215704 \| \| scaffold14851_1223922_SNP | 1223922 | A | G |
| S_9215710 \| \| scaffold14851_1224013_SNP | 1224013 | C | A |
| S_9215712 \| \| scaffold14851_1224067_SNP | 1224067 | T | C |
| S_9215725 \| \| scaffold14851_1224388_SNP | 1224388 | T | C |
| S_9215728 \| \| scaffold14851_1224399_SNP | 1224399 | C | T |
| S_9215737 \| \| scaffold14851_1224603_SNP | 1224603 | G | C |
| S_9215800 \| \| scaffold14851_1224976_SNP | 1224976 | A | G |
| S_9215817 \| \| scaffold14851_1225015_SNP | 1225015 | T | C |
| S_9215935 \| \| scaffold14851_1226631_SNP | 1226631 | A | T |
| S_9215937 \| \| scaffold14851_1226646_SNP | 1226646 | G | A |
| S_9215951 \| \| scaffold14851_1226839_SNP | 1226839 | A | T |
| S_9215952 \| \| scaffold14851_1226841_SNP | 1226841 | A | C |
| S_9215957 \| \| scaffold14851_1227055_SNP | 1227055 | C | T |
| S_9215966 \| \| scaffold14851_1227151_SNP | 1227151 | T | A |
| S_9215972 \| \| scaffold14851_1227266_SNP | 1227266 | T | A |
| S_9215982 \| \| scaffold14851_1227592_SNP | 1227592 | G | A |
| S_9215999 \| \| scaffold14851_1227868_SNP | 1227868 | C | T |
| S_9216002 \| \| scaffold14851_1227878_SNP | 1227878 | C | T |
| S_9216023 \| \| scaffold14851_1228078_SNP | 1228078 | T | G |
| S_9216024 \| \| scaffold14851_1228086_SNP | 1228086 | C | T |
| S_9216031 \| \| scaffold14851_1228156_SNP | 1228156 | A | C |
| S_9216057 \| \| scaffold14851_1228424_SNP | 1228424 | G | T |
| S_9216087 \| \| scaffold14851_1228756_SNP | 1228756 | C | T |
| S_9216139 \| \| scaffold14851_1229274_SNP | 1229274 | A | C |
| S_9216163 \| \| scaffold14851_1229877_SNP | 1229877 | T | G |
| S_9216322 \| \| scaffold14851_1232000_SNP | 1232000 | C | G |
| S_9216340 \| \| scaffold14851_1232279_SNP | 1232279 | A | G |
| S_9216351 \| \| scaffold14851_1232435_SNP | 1232435 | C | T |
| S_9216376 \| \| scaffold14851_1232759_SNP | 1232759 | T | C |
| S_9216554 \| \| scaffold14851_1234995_SNP | 1234995 | A | T |
| S_9216568 \| \| scaffold14851_1235336_SNP | 1235336 | T | G |
| S_9216695 \| \| scaffold14851_1236463_SNP | 1236463 | G | C |
| S_9216699 \| \| scaffold14851_1236515_SNP | 1236515 | T | C |
| S_9216701 \| \| scaffold14851_1236557_SNP | 1236557 | G | T |
| S_9216800 \| \| scaffold14851_1238035_SNP | 1238035 | T | A |
| S_9216807 \| \| scaffold14851_1238136_SNP | 1238136 | C | T |
| S_9216818 \| \| scaffold14851_1238289_SNP | 1238289 | T | C |
| S_9216819 \| \| scaffold14851_1238290_SNP | 1238290 | T | A |
| S_9216820 \| \| scaffold14851_1238291_SNP | 1238291 | G | T |
| S_9216821 \| \| scaffold14851_1238292_SNP | 1238292 | T | A |
| S_9216828 \| \| scaffold14851_1238364_SNP | 1238364 | T | G |
| S_9216831 \| \| scaffold14851_1238447_SNP | 1238447 | C | T |
| S_9216868 \| \| scaffold14851_1238751_SNP | 1238751 | C | T |
| S_9216871 \| \| scaffold14851_1238840_SNP | 1238840 | C | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9216872 \| \| scaffold14851_1238849_SNP | 1238849 | G | A |
| S_9216873 \| \| scaffold14851_1238872_SNP | 1238872 | A | T |
| S_9216956 \| \| scaffold14851_1239813_SNP | 1239813 | A | T |
| S_9216984 \| \| scaffold14851_1240287_SNP | 1240287 | T | C |
| S_9216998 \| \| scaffold14851_1240500_SNP | 1240500 | T | G |
| S_9217004 \| \| scaffold14851_1240553_SNP | 1240553 | C | T |
| S_9217125 \| \| scaffold14851_1242320_SNP | 1242320 | C | T |
| S_9217158 \| \| scaffold14851_1242743_SNP | 1242743 | G | A |
| S_9217159 \| \| scaffold14851_1242757_SNP | 1242757 | G | A |
| S_9217175 \| \| scaffold14851_1243124_SNP | 1243124 | A | G |
| S_9217183 \| \| scaffold14851_1243299_SNP | 1243299 | T | G |
| S_9217185 \| \| scaffold14851_1243310_SNP | 1243310 | G | A |
| S_9217186 \| \| scaffold14851_1243316_SNP | 1243316 | C | A |
| S_9217187 \| \| scaffold14851_1243323_SNP | 1243323 | A | G |
| S_9217189 \| \| scaffold14851_1243357_SNP | 1243357 | C | A |
| S_9217191 \| \| scaffold14851_1243410_SNP | 1243410 | T | C |
| S_9217200 \| \| scaffold14851_1243487_SNP | 1243487 | C | T |
| S_9217205 \| \| scaffold14851_1243560_SNP | 1243560 | T | C |
| S_9217210 \| \| scaffold14851_1243595_SNP | 1243595 | T | G |
| scaffold14851_1244047_SNP | 1244047 | C | A |
| S_9217277 \| \| scaffold14851_1244083_SNP | 1244083 | A | G |
| S_9217291 \| \| scaffold14851_1244288_SNP | 1244288 | T | C |
| S_9217292 \| \| scaffold14851_1244295_SNP | 1244295 | C | G |
| S_9217325 \| \| scaffold14851_1244827_SNP | 1244827 | C | T |
| S_9217326 \| \| scaffold14851_1244828_SNP | 1244828 | T | G |
| S_9217327 \| \| scaffold14851_1244829_SNP | 1244829 | A | T |
| S_9217351 \| \| scaffold14851_1245187_SNP | 1245187 | A | C |
| S_9217370 \| \| scaffold14851_1245634_SNP | 1245634 | T | C |
| S_9217409 \| \| scaffold14851_1246039_SNP | 1246039 | C | T |
| S_9217421 \| \| scaffold14851_1246261_SNP | 1246261 | T | A |
| S_9217467 \| \| scaffold14851_1246928_SNP | 1246928 | G | A |
| S_9217491 \| \| scaffold14851_1247295_SNP | 1247295 | C | A |
| S_9217503 \| \| scaffold14851_1247613_SNP | 1247613 | G | A |
| S_9217516 \| \| scaffold14851_1247829_SNP | 1247829 | G | A |
| S_9217521 \| \| scaffold14851_1247921_SNP | 1247921 | A | T |
| S_9217542 \| \| scaffold14851_1248287_SNP | 1248287 | T | C |
| S_9217548 \| \| scaffold14851_1248403_SNP | 1248403 | C | A |
| S_9217555 \| \| scaffold14851_1248453_SNP | 1248453 | C | T |
| S_9217556 \| \| scaffold14851_1248464_SNP | 1248464 | G | T |
| S_9217567 \| \| scaffold14851_1248633_SNP | 1248633 | T | C |
| S_9217570 \| \| scaffold14851_1248677_SNP | 1248677 | G | A |
| S_9217573 \| \| scaffold14851_1248687_SNP | 1248687 | C | T |
| S_9217574 \| \| scaffold14851_1248700_SNP | 1248700 | G | A |
| S_9217575 \| \| scaffold14851_1248732_SNP | 1248732 | C | T |
| S_9217581 \| \| scaffold14851_1248763_SNP | 1248763 | A | G |
| S_9217586 \| \| scaffold14851_1248818_SNP | 1248818 | G | A |
| S_9217593 \| \| scaffold14851_1248914_SNP | 1248914 | C | T |
| S_9217596 \| \| scaffold14851_1248941_SNP | 1248941 | A | G |
| S_9217598 \| \| scaffold14851_1249013_SNP | 1249013 | T | C |
| S_9217600 \| \| scaffold14851_1249041_SNP | 1249041 | G | A |
| S_9217648 \| \| scaffold14851_1249235_SNP | 1249235 | T | C |
| S_9217691 \| \| scaffold14851_1249638_SNP | 1249638 | G | A |
| S_9217692 \| \| scaffold14851_1249639_SNP | 1249639 | A | C |
| S_9217767 \| \| scaffold14851_1250773_SNP | 1250773 | G | A |
| S_9217779 \| \| scaffold14851_1250923_SNP | 1250923 | T | A |
| S_9217906 \| \| scaffold14851_1252888_SNP | 1252888 | T | A |
| S_9217914 \| \| scaffold14851_1253043_SNP | 1253043 | T | A |
| S_9217930 \| \| scaffold14851_1253314_SNP | 1253314 | G | A |
| S_9217933 \| \| scaffold14851_1253357_SNP | 1253357 | G | T |
| S_9217949 \| \| scaffold14851_1253676_SNP | 1253676 | G | T |
| S_9217959 \| \| scaffold14851_1253830_SNP | 1253830 | T | C |
| S_9217968 \| \| scaffold14851_1254021_SNP | 1254021 | T | G |
| S_9217970 \| \| scaffold14851_1254088_SNP | 1254088 | A | C |
| S_9217985 \| \| scaffold14851_1254482_SNP | 1254482 | T | G |
| S_9218008 \| \| scaffold14851_1254703_SNP | 1254703 | T | C |
| S_9218009 \| \| scaffold14851_1254704_SNP | 1254704 | C | T |
| S_9218157 \| \| scaffold14851_1255379_SNP | 1255379 | T | C |
| S_9218163 \| \| scaffold14851_1255425_SNP | 1255425 | A | G |
| S_9218164 \| \| scaffold14851_1255437_SNP | 1255437 | G | A |
| S_9218178 \| \| scaffold14851_1255482_SNP | 1255482 | T | C |
| S_9218184 \| \| scaffold14851_1255500_SNP | 1255500 | C | A |
| S_9218185 \| \| scaffold14851_1255513_SNP | 1255513 | C | A |
| S_9218240 \| \| scaffold14851_1256488_SNP | 1256488 | A | G |
| S_9218263 \| \| scaffold14851_1256865_SNP | 1256865 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9218408 \| \| scaffold14851_1259035_SNP | 1259035 | A | G |
| S_9218424 \| \| scaffold14851_1259244_SNP | 1259244 | C | T |
| S_9218437 \| \| scaffold14851_1259401_SNP | 1259401 | A | G |
| S_9218448 \| \| scaffold14851_1259569_SNP | 1259569 | G | A |
| S_9218467 \| \| scaffold14851_1259937_SNP | 1259937 | T | C |
| S_9218470 \| \| scaffold14851_1259957_SNP | 1259957 | T | C |
| S_9218481 \| \| scaffold14851_1260152_SNP | 1260152 | T | C |
| S_9218491 \| \| scaffold14851_1260413_SNP | 1260413 | T | C |
| S_9218523 \| \| scaffold14851_1260678_SNP | 1260678 | G | C |
| S_9218530 \| \| scaffold14851_1260760_SNP | 1260760 | T | C |
| S_9218540 \| \| scaffold14851_1261097_SNP | 1261097 | C | T |
| S_9218561 \| \| scaffold14851_1261375_SNP | 1261375 | A | G |
| S_9218578 \| \| scaffold14851_1261579_SNP | 1261579 | A | G |
| S_9218589 \| \| scaffold14851_1261777_SNP | 1261777 | A | G |
| S_9218595 \| \| scaffold14851_1261835_SNP | 1261835 | G | A |
| S_9218598 \| \| scaffold14851_1261872_SNP | 1261872 | T | G |
| S_9218610 \| \| scaffold14851_1262109_SNP | 1262109 | C | T |
| S_9218686 \| \| scaffold14851_1263214_SNP | 1263214 | A | G |
| S_9218705 \| \| scaffold14851_1263523_SNP | 1263523 | G | T |
| S_9218708 \| \| scaffold14851_1263598_SNP | 1263598 | A | G |
| S_9218710 \| \| scaffold14851_1263637_SNP | 1263637 | C | T |
| S_9218732 \| \| scaffold14851_1263913_SNP | 1263913 | C | T |
| S_9218758 \| \| scaffold14851_1264352_SNP | 1264352 | G | A |
| S_9218796 \| \| scaffold14851_1265033_SNP | 1265033 | C | T |
| S_9218923 \| \| scaffold14851_1266288_SNP | 1266288 | A | T |
| S_9218950 \| \| scaffold14851_1266632_SNP | 1266632 | C | G |
| S_9219005 \| \| scaffold14851_1267392_SNP | 1267392 | T | A |
| S_9219058 \| \| scaffold14851_1268209_SNP | 1268209 | G | A |
| S_9219109 \| \| scaffold14851_1268680_SNP | 1268680 | C | G |
| S_9219119 \| \| scaffold14851_1268741_SNP | 1268741 | T | C |
| S_9219124 \| \| scaffold14851_1268871_SNP | 1268871 | G | A |
| S_9219132 \| \| scaffold14851_1269098_SNP | 1269098 | T | A |
| S_9219137 \| \| scaffold14851_1269140_SNP | 1269140 | A | T |
| S_9219156 \| \| scaffold14851_1269505_SNP | 1269505 | G | C |
| S_9219291 \| \| scaffold14851_1271263_SNP | 1271263 | G | A |
| S_9219372 \| \| scaffold14851_1272434_SNP | 1272434 | T | A |
| S_9219374 \| \| scaffold14851_1272449_SNP | 1272449 | C | T |
| S_9219383 \| \| scaffold14851_1272519_SNP | 1272519 | C | A |
| S_9219540 \| \| scaffold14851_1273691_SNP | 1273691 | T | C |
| S_9219559 \| \| scaffold14851_1273854_SNP | 1273854 | T | C |
| S_9219626 \| \| scaffold14851_1274003_SNP | 1274003 | T | A |
| S_9219627 \| \| scaffold14851_1274005_SNP | 1274005 | A | T |
| S_9219628 \| \| scaffold14851_1274018_SNP | 1274018 | A | C |
| S_9219630 \| \| scaffold14851_1274078_SNP | 1274078 | G | T |
| S_9219638 \| \| scaffold14851_1274379_SNP | 1274379 | A | T |
| S_9219643 \| \| scaffold14851_1274453_SNP | 1274453 | G | A |
| S_9219648 \| \| scaffold14851_1274510_SNP | 1274510 | C | G |
| S_9219655 \| \| scaffold14851_1274615_SNP | 1274615 | T | C |
| S_9219656 \| \| scaffold14851_1274620_SNP | 1274620 | C | T |
| S_9219659 \| \| scaffold14851_1274695_SNP | 1274695 | G | T |
| S_9219662 \| \| scaffold14851_1274721_SNP | 1274721 | T | A |
| S_9219664 \| \| scaffold14851_1274766_SNP | 1274766 | T | C |
| S_9219667 \| \| scaffold14851_1274772_SNP | 1274772 | A | T |
| S_9219671 \| \| scaffold14851_1274837_SNP | 1274837 | A | T |
| S_9219677 \| \| scaffold14851_1275001_SNP | 1275001 | G | A |
| S_9219679 \| \| scaffold14851_1275021_SNP | 1275021 | T | C |
| S_9219682 \| \| scaffold14851_1275024_SNP | 1275024 | G | C |
| S_9219683 \| \| scaffold14851_1275037_SNP | 1275037 | T | C |
| S_9219692 \| \| scaffold14851_1275188_SNP | 1275188 | G | A |
| S_9219693 \| \| scaffold14851_1275201_SNP | 1275201 | C | T |
| S_9219696 \| \| scaffold14851_1275243_SNP | 1275243 | C | T |
| S_9219697 \| \| scaffold14851_1275313_SNP | 1275313 | C | T |
| S_9219735 \| \| scaffold14851_1275808_SNP | 1275808 | T | A |
| S_9219742 \| \| scaffold14851_1275898_SNP | 1275898 | G | A |
| S_9219761 \| \| scaffold14851_1276244_SNP | 1276244 | A | G |
| S_9219768 \| \| scaffold14851_1276420_SNP | 1276420 | C | T |
| S_9219777 \| \| scaffold14851_1276497_SNP | 1276497 | T | C |
| S_9219784 \| \| scaffold14851_1276550_SNP | 1276550 | C | T |
| S_9219786 \| \| scaffold14851_1276571_SNP | 1276571 | T | A |
| S_9219801 \| \| scaffold14851_1276693_SNP | 1276693 | A | T |
| S_9219850 \| \| scaffold14851_1277056_SNP | 1277056 | T | C |
| S_9219885 \| \| scaffold14851_1277608_SNP | 1277608 | C | T |
| S_9219891 \| \| scaffold14851_1277625_SNP | 1277625 | A | T |
| S_9219904 \| \| scaffold14851_1277753_SNP | 1277753 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9219922 \|\| scaffold14851_1278097_SNP | 1278097 | T | C |
| S_9219923 \|\| scaffold14851_1278129_SNP | 1278129 | A | C |
| S_9219940 \|\| scaffold14851_1278416_SNP | 1278416 | T | C |
| S_9219942 \|\| scaffold14851_1278461_SNP | 1278461 | A | G |
| S_9219945 \|\| scaffold14851_1278487_SNP | 1278487 | C | A |
| S_9219969 \|\| scaffold14851_1278841_SNP | 1278841 | C | T |
| S_9220013 \|\| scaffold14851_1279759_SNP | 1279759 | C | A |
| S_9220016 \|\| scaffold14851_1279839_SNP | 1279839 | T | A |
| S_9220060 \|\| scaffold14851_1280548_SNP | 1280548 | A | T |
| S_9220078 \|\| scaffold14851_1280889_SNP | 1280889 | G | A |
| S_9220087 \|\| scaffold14851_1281042_SNP | 1281042 | G | A |
| S_9220089 \|\| scaffold14851_1281065_SNP | 1281065 | C | T |
| S_9220102 \|\| scaffold14851_1281254_SNP | 1281254 | A | T |
| S_9220106 \|\| scaffold14851_1281361_SNP | 1281361 | G | A |
| S_9220108 \|\| scaffold14851_1281375_SNP | 1281375 | C | G |
| S_9220115 \|\| scaffold14851_1281471_SNP | 1281471 | A | T |
| S_9220116 \|\| scaffold14851_1281511_SNP | 1281511 | G | A |
| S_9220118 \|\| scaffold14851_1281570_SNP | 1281570 | A | T |
| S_9220241 \|\| scaffold14851_1282237_SNP | 1282237 | A | T |
| S_9220243 \|\| scaffold14851_1282294_SNP | 1282294 | T | C |
| S_9220267 \|\| scaffold14851_1282730_SNP | 1282730 | A | G |
| S_9220276 \|\| scaffold14851_1282870_SNP | 1282870 | C | T |
| S_9220279 \|\| scaffold14851_1282928_SNP | 1282928 | C | G |
| S_9220290 \|\| scaffold14851_1283151_SNP | 1283151 | G | A |
| S_9220291 \|\| scaffold14851_1283163_SNP | 1283163 | A | T |
| S_9220311 \|\| scaffold14851_1283614_SNP | 1283614 | T | C |
| S_9220312 \|\| scaffold14851_1283621_SNP | 1283621 | T | C |
| S_9220315 \|\| scaffold14851_1283660_SNP | 1283660 | C | A |
| S_9220327 \|\| scaffold14851_1283786_SNP | 1283786 | A | G |
| S_9220329 \|\| scaffold14851_1283798_SNP | 1283798 | T | C |
| S_9220334 \|\| scaffold14851_1283846_SNP | 1283846 | G | A |
| S_9220414 \|\| scaffold14851_1284927_SNP | 1284927 | T | C |
| S_9220415 \|\| scaffold14851_1284941_SNP | 1284941 | G | A |
| S_9220417 \|\| scaffold14851_1284986_SNP | 1284986 | G | A |
| S_9220419 \|\| scaffold14851_1285005_SNP | 1285005 | G | A |
| S_9220424 \|\| scaffold14851_1285048_SNP | 1285048 | A | T |
| S_9220432 \|\| scaffold14851_1285175_SNP | 1285175 | G | C |
| S_9220507 \|\| scaffold14851_1285883_SNP | 1285883 | A | G |
| S_9220508 \|\| scaffold14851_1285920_SNP | 1285920 | A | T |
| S_9220646 \|\| scaffold14851_1294237_SNP | 1294237 | C | A |
| S_9220647 \|\| scaffold14851_1294247_SNP | 1294247 | G | A |
| S_9220660 \|\| scaffold14851_1294381_SNP | 1294381 | G | T |
| S_9220669 \|\| scaffold14851_1294492_SNP | 1294492 | G | T |
| S_9220706 \|\| scaffold14851_1295135_SNP | 1295135 | G | A |
| S_9220884 \|\| scaffold14851_1297253_SNP | 1297253 | C | T |
| S_9220893 \|\| scaffold14851_1297423_SNP | 1297423 | C | G |
| S_9220939 \|\| scaffold14851_1298211_SNP | 1298211 | G | A |
| S_9220962 \|\| scaffold14851_1298695_SNP | 1298695 | C | T |
| S_9220968 \|\| scaffold14851_1298905_SNP | 1298905 | G | C |
| S_9221027 \|\| scaffold14851_1300002_SNP | 1300002 | C | A |
| S_9221031 \|\| scaffold14851_1300013_SNP | 1300013 | A | T |
| S_9221067 \|\| scaffold14851_1300379_SNP | 1300379 | G | A |
| S_9221158 \|\| scaffold14851_1301161_SNP | 1301161 | A | C |
| S_9221206 \|\| scaffold14851_1301863_SNP | 1301863 | G | C |
| S_9221208 \|\| scaffold14851_1301882_SNP | 1301882 | T | C |
| S_9221211 \|\| scaffold14851_1301937_SNP | 1301937 | C | T |
| S_9221294 \|\| scaffold14851_1303770_SNP | 1303770 | G | T |
| S_9221297 \|\| scaffold14851_1303875_SNP | 1303875 | T | A |
| S_9221307 \|\| scaffold14851_1304049_SNP | 1304049 | T | G |
| S_9221308 \|\| scaffold14851_1304058_SNP | 1304058 | A | C |
| S_9221316 \|\| scaffold14851_1304289_SNP | 1304289 | A | G |
| S_9221323 \|\| scaffold14851_1304413_SNP | 1304413 | T | C |
| S_9221337 \|\| scaffold14851_1304599_SNP | 1304599 | T | G |
| S_9221358 \|\| scaffold14851_1304992_SNP | 1304992 | T | A |
| S_9221361 \|\| scaffold14851_1305049_SNP | 1305049 | T | G |
| S_9221449 \|\| scaffold14851_1305691_SNP | 1305691 | T | C |
| S_9221452 \|\| scaffold14851_1305714_SNP | 1305714 | A | C |
| S_9221470 \|\| scaffold14851_1306007_SNP | 1306007 | C | A |
| S_9221471 \|\| scaffold14851_1306013_SNP | 1306013 | G | A |
| S_9221474 \|\| scaffold14851_1306026_SNP | 1306026 | C | A |
| S_9221488 \|\| scaffold14851_1306260_SNP | 1306260 | A | T |
| S_9221491 \|\| scaffold14851_1306276_SNP | 1306276 | G | C |
| S_9221500 \|\| scaffold14851_1306389_SNP | 1306389 | A | G |
| S_9221505 \|\| scaffold14851_1306451_SNP | 1306451 | A | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9221506 \| \| scaffold14851_1306453_SNP | 1306453 | A | C |
| S_9221650 \| \| scaffold14851_1308202_SNP | 1308202 | T | A |
| S_9221752 \| \| scaffold14851_1309305_SNP | 1309305 | T | C |
| S_9221810 \| \| scaffold14851_1309757_SNP | 1309757 | A | G |
| S_9221891 \| \| scaffold14851_1311077_SNP | 1311077 | T | C |
| S_9221946 \| \| scaffold14851_1311766_SNP | 1311766 | C | A |
| S_9221952 \| \| scaffold14851_1311833_SNP | 1311833 | C | T |
| S_9221989 \| \| scaffold14851_1312240_SNP | 1312240 | C | T |
| S_9222055 \| \| scaffold14851_1312709_SNP | 1312709 | C | A |
| S_9222056 \| \| scaffold14851_1312741_SNP | 1312741 | C | T |
| S_9222121 \| \| scaffold14851_1313280_SNP | 1313280 | T | C |
| S_9222124 \| \| scaffold14851_1313305_SNP | 1313305 | G | A |
| S_9222141 \| \| scaffold14851_1313439_SNP | 1313439 | T | G |
| S_9222142 \| \| scaffold14851_1313453_SNP | 1313453 | A | G |
| S_9222157 \| \| scaffold14851_1313594_SNP | 1313594 | A | G |
| S_9222160 \| \| scaffold14851_1313627_SNP | 1313627 | A | G |
| S_9222161 \| \| scaffold14851_1313649_SNP | 1313649 | G | T |
| S_9222181 \| \| scaffold14851_1313782_SNP | 1313782 | C | T |
| S_9222197 \| \| scaffold14851_1313981_SNP | 1313981 | T | C |
| S_9222199 \| \| scaffold14851_1314016_SNP | 1314016 | T | A |
| S_9222200 \| \| scaffold14851_1314017_SNP | 1314017 | T | A |
| S_9222201 \| \| scaffold14851_1314018_SNP | 1314018 | T | A |
| S_9222204 \| \| scaffold14851_1314057_SNP | 1314057 | C | A |
| S_9222228 \| \| scaffold14851_1314339_SNP | 1314339 | C | T |
| S_9222230 \| \| scaffold14851_1314364_SNP | 1314364 | A | G |
| S_9222234 \| \| scaffold14851_1314395_SNP | 1314395 | C | T |
| S_9222238 \| \| scaffold14851_1314427_SNP | 1314427 | C | T |
| S_9222244 \| \| scaffold14851_1314475_SNP | 1314475 | C | A |
| S_9222254 \| \| scaffold14851_1314631_SNP | 1314631 | C | A |
| S_9222261 \| \| scaffold14851_1314692_SNP | 1314692 | A | G |
| S_9222296 \| \| scaffold14851_1315247_SNP | 1315247 | C | T |
| S_9222368 \| \| scaffold14851_1316584_SNP | 1316584 | G | A |
| S_9222401 \| \| scaffold14851_1316863_SNP | 1316863 | C | G |
| S_9222402 \| \| scaffold14851_1316869_SNP | 1316869 | C | T |
| S_9222414 \| \| scaffold14851_1316986_SNP | 1316986 | A | C |
| S_9222463 \| \| scaffold14851_1317481_SNP | 1317481 | G | A |
| S_9222474 \| \| scaffold14851_1317639_SNP | 1317639 | C | T |
| S_9222475 \| \| scaffold14851_1317652_SNP | 1317652 | G | T |
| S_9222486 \| \| scaffold14851_1317812_SNP | 1317812 | A | G |
| S_9222497 \| \| scaffold14851_1317995_SNP | 1317995 | G | A |
| S_9222513 \| \| scaffold14851_1318349_SNP | 1318349 | G | T |
| S_9222514 \| \| scaffold14851_1318351_SNP | 1318351 | C | G |
| S_9222515 \| \| scaffold14851_1318378_SNP | 1318378 | G | T |
| S_9222519 \| \| scaffold14851_1318413_SNP | 1318413 | A | G |
| S_9222535 \| \| scaffold14851_1318536_SNP | 1318536 | T | G |
| S_9222553 \| \| scaffold14851_1318645_SNP | 1318645 | T | C |
| S_9222554 \| \| scaffold14851_1318646_SNP | 1318646 | G | C |
| S_9222575 \| \| scaffold14851_1318907_SNP | 1318907 | G | A |
| S_9222579 \| \| scaffold14851_1318960_SNP | 1318960 | C | T |
| S_9222635 \| \| scaffold14851_1319563_SNP | 1319563 | A | G |
| S_9222641 \| \| scaffold14851_1319612_SNP | 1319612 | T | C |
| S_9222646 \| \| scaffold14851_1319705_SNP | 1319705 | A | T |
| S_9222648 \| \| scaffold14851_1319718_SNP | 1319718 | A | G |
| S_9222683 \| \| scaffold14851_1320290_SNP | 1320290 | G | A |
| S_9222699 \| \| scaffold14851_1320622_SNP | 1320622 | G | A |
| S_9222700 \| \| scaffold14851_1320648_SNP | 1320648 | T | C |
| S_9222767 \| \| scaffold14851_1321499_SNP | 1321499 | T | C |
| S_9222779 \| \| scaffold14851_1321524_SNP | 1321524 | T | A |
| S_9222799 \| \| scaffold14851_1321767_SNP | 1321767 | A | T |
| S_9222801 \| \| scaffold14851_1321800_SNP | 1321800 | A | G |
| S_9222802 \| \| scaffold14851_1321830_SNP | 1321830 | C | T |
| S_9223035 \| \| scaffold14851_1326020_SNP | 1326020 | G | A |
| S_9223046 \| \| scaffold14851_1326214_SNP | 1326214 | C | T |
| S_9223054 \| \| scaffold14851_1326289_SNP | 1326289 | A | G |
| S_9223412 \| \| scaffold14851_1328391_SNP | 1328391 | T | C |
| S_9223432 \| \| scaffold14851_1328515_SNP | 1328515 | T | C |
| scaffold14851_1329982_SNP | 1329982 | T | G |
| S_9223820 \| \| scaffold14851_1331147_SNP | 1331147 | T | A |
| scaffold14851_1334237_SNP | 1334237 | G | T |
| S_9224208 \| \| scaffold14851_1334289_SNP | 1334289 | A | C |
| scaffold14851_1334313_SNP | 1334313 | T | G |
| S_9224215 \| \| scaffold14851_1334398_SNP | 1334398 | G | A |
| S_9224271 \| \| scaffold14851_1335088_SNP | 1335088 | A | C |
| S_9224272 \| \| scaffold14851_1335094_SNP | 1335094 | T | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9224301 \| \| scaffold14851_1335509_SNP | 1335509 | C | G |
| S_9224454 \| \| scaffold14851_1336879_SNP | 1336879 | C | T |
| S_9224740 \| \| scaffold14851_1339636_SNP | 1339636 | A | G |
| S_9224785 \| \| scaffold14851_1339829_SNP | 1339829 | T | A |
| S_9224786 \| \| scaffold14851_1339867_SNP | 1339867 | A | G |
| S_9224802 \| \| scaffold14851_1340064_SNP | 1340064 | T | A |
| S_9224830 \| \| scaffold14851_1340584_SNP | 1340584 | T | C |
| S_9224867 \| \| scaffold14851_1340946_SNP | 1340946 | G | A |
| S_9224878 \| \| scaffold14851_1341131_SNP | 1341131 | G | A |
| S_9224911 \| \| scaffold14851_1341572_SNP | 1341572 | A | G |
| S_9224977 \| \| scaffold14851_1342439_SNP | 1342439 | T | C |
| S_9224987 \| \| scaffold14851_1342588_SNP | 1342588 | T | A |
| S_9224988 \| \| scaffold14851_1342593_SNP | 1342593 | A | G |
| S_9224993 \| \| scaffold14851_1342681_SNP | 1342681 | C | T |
| S_9225020 \| \| scaffold14851_1343087_SNP | 1343087 | G | T |
| S_9225064 \| \| scaffold14851_1343487_SNP | 1343487 | C | A |
| S_9225077 \| \| scaffold14851_1343729_SNP | 1343729 | C | G |
| S_9225084 \| \| scaffold14851_1343850_SNP | 1343850 | A | G |
| S_9225085 \| \| scaffold14851_1343887_SNP | 1343887 | G | A |
| S_9225091 \| \| scaffold14851_1344060_SNP | 1344060 | G | A |
| S_9225092 \| \| scaffold14851_1344062_SNP | 1344062 | T | C |
| S_9225100 \| \| scaffold14851_1344257_SNP | 1344257 | A | T |
| S_9225123 \| \| scaffold14851_1344636_SNP | 1344636 | T | G |
| S_9225124 \| \| scaffold14851_1344648_SNP | 1344648 | C | T |
| S_9225126 \| \| scaffold14851_1344681_SNP | 1344681 | T | C |
| S_9225127 \| \| scaffold14851_1344695_SNP | 1344695 | A | G |
| S_9225147 \| \| scaffold14851_1345087_SNP | 1345087 | T | A |
| S_9225332 \| \| scaffold14851_1347124_SNP | 1347124 | T | G |
| S_9225377 \| \| scaffold14851_1347613_SNP | 1347613 | T | C |
| S_9225384 \| \| scaffold14851_1347827_SNP | 1347827 | C | G |
| S_9225385 \| \| scaffold14851_1347836_SNP | 1347836 | C | T |
| S_9225400 \| \| scaffold14851_1348074_SNP | 1348074 | G | C |
| S_9225405 \| \| scaffold14851_1348161_SNP | 1348161 | T | C |
| S_9225406 \| \| scaffold14851_1348165_SNP | 1348165 | C | G |
| S_9225408 \| \| scaffold14851_1348216_SNP | 1348216 | A | C |
| S_9225410 \| \| scaffold14851_1348222_SNP | 1348222 | G | A |
| S_9225475 \| \| scaffold14851_1348790_SNP | 1348790 | A | G |
| S_9225477 \| \| scaffold14851_1348823_SNP | 1348823 | A | C |
| S_9225503 \| \| scaffold14851_1349218_SNP | 1349218 | A | T |
| scaffold14851_1349324_SNP | 1349324 | T | A |
| S_9225520 \| \| scaffold14851_1349523_SNP | 1349523 | G | C |
| S_9225521 \| \| scaffold14851_1349544_SNP | 1349544 | A | G |
| S_9225523 \| \| scaffold14851_1349622_SNP | 1349622 | C | T |
| S_9225565 \| \| scaffold14851_1349902_SNP | 1349902 | C | G |
| S_9225610 \| \| scaffold14851_1350440_SNP | 1350440 | T | A |
| S_9225614 \| \| scaffold14851_1350515_SNP | 1350515 | T | A |
| S_9225673 \| \| scaffold14851_1351371_SNP | 1351371 | C | T |
| S_9225675 \| \| scaffold14851_1351422_SNP | 1351422 | T | C |
| S_9225728 \| \| scaffold14851_1352177_SNP | 1352177 | G | A |
| S_9225735 \| \| scaffold14851_1352531_SNP | 1352531 | G | A |
| S_9225739 \| \| scaffold14851_1352611_SNP | 1352611 | T | C |
| S_9225742 \| \| scaffold14851_1352736_SNP | 1352736 | G | A |
| S_9225743 \| \| scaffold14851_1352763_SNP | 1352763 | C | G |
| S_9225752 \| \| scaffold14851_1352848_SNP | 1352848 | C | A |
| S_9225753 \| \| scaffold14851_1352858_SNP | 1352858 | C | T |
| scaffold14851_1353037_SNP | 1353037 | T | G |
| scaffold14851_1353039_SNP | 1353039 | G | C |
| scaffold14851_1353041_SNP | 1353041 | T | G |
| S_9226010 \| \| scaffold14851_1355276_SNP | 1355276 | A | G |
| S_9226012 \| \| scaffold14851_1355281_SNP | 1355281 | G | A |
| S_9226033 \| \| scaffold14851_1355691_SNP | 1355691 | G | A |
| S_9226034 \| \| scaffold14851_1355695_SNP | 1355695 | A | G |
| S_9226045 \| \| scaffold14851_1355840_SNP | 1355840 | G | T |
| S_9226046 \| \| scaffold14851_1355841_SNP | 1355841 | T | C |
| S_9226047 \| \| scaffold14851_1355845_SNP | 1355845 | T | G |
| S_9226120 \| \| scaffold14851_1356917_SNP | 1356917 | T | C |
| S_9226121 \| \| scaffold14851_1356964_SNP | 1356964 | A | G |
| S_9226152 \| \| scaffold14851_1357315_SNP | 1357315 | G | T |
| S_9226156 \| \| scaffold14851_1357375_SNP | 1357375 | G | T |
| S_9226167 \| \| scaffold14851_1357561_SNP | 1357561 | A | C |
| S_9226171 \| \| scaffold14851_1357638_SNP | 1357638 | T | C |
| S_9226176 \| \| scaffold14851_1357680_SNP | 1357680 | A | G |
| S_9226211 \| \| scaffold14851_1358305_SNP | 1358305 | G | A |
| S_9226214 \| \| scaffold14851_1358336_SNP | 1358336 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9226229 \| \| scaffold14851_1358567_SNP | 1358567 | A | T |
| S_9226230 \| \| scaffold14851_1358591_SNP | 1358591 | G | A |
| S_9226248 \| \| scaffold14851_1358805_SNP | 1358805 | A | G |
| S_9226250 \| \| scaffold14851_1358880_SNP | 1358880 | G | A |
| S_9226267 \| \| scaffold14851_1359376_SNP | 1359376 | G | T |
| S_9226319 \| \| scaffold14851_1359816_SNP | 1359816 | A | T |
| S_9226321 \| \| scaffold14851_1359891_SNP | 1359891 | G | T |
| S_9226332 \| \| scaffold14851_1360045_SNP | 1360045 | C | A |
| S_9226334 \| \| scaffold14851_1360111_SNP | 1360111 | A | T |
| S_9226337 \| \| scaffold14851_1360177_SNP | 1360177 | C | T |
| S_9226340 \| \| scaffold14851_1360195_SNP | 1360195 | G | T |
| S_9226363 \| \| scaffold14851_1360489_SNP | 1360489 | C | T |
| S_9226374 \| \| scaffold14851_1360625_SNP | 1360625 | T | C |
| S_9226393 \| \| scaffold14851_1360890_SNP | 1360890 | C | T |
| S_9226394 \| \| scaffold14851_1360891_SNP | 1360891 | A | T |
| S_9226396 \| \| scaffold14851_1360902_SNP | 1360902 | C | T |
| S_9226397 \| \| scaffold14851_1360912_SNP | 1360912 | T | G |
| S_9226434 \| \| scaffold14851_1361179_SNP | 1361179 | T | G |
| S_9226445 \| \| scaffold14851_1361301_SNP | 1361301 | G | C |
| S_9226446 \| \| scaffold14851_1361331_SNP | 1361331 | G | C |
| S_9226467 \| \| scaffold14851_1361728_SNP | 1361728 | T | C |
| S_9226492 \| \| scaffold14851_1362063_SNP | 1362063 | G | T |
| S_9226495 \| \| scaffold14851_1362123_SNP | 1362123 | T | C |
| S_9226519 \| \| scaffold14851_1362428_SNP | 1362428 | T | G |
| S_9226535 \| \| scaffold14851_1362639_SNP | 1362639 | G | A |
| S_9226541 \| \| scaffold14851_1362727_SNP | 1362727 | T | A |
| S_9226669 \| \| scaffold14851_1363706_SNP | 1363706 | T | G |
| S_9226670 \| \| scaffold14851_1363722_SNP | 1363722 | G | A |
| S_9226690 \| \| scaffold14851_1364120_SNP | 1364120 | T | C |
| S_9226723 \| \| scaffold14851_1364577_SNP | 1364577 | G | A |
| S_9226724 \| \| scaffold14851_1364626_SNP | 1364626 | G | A |
| S_9226732 \| \| scaffold14851_1364776_SNP | 1364776 | A | T |
| S_9226733 \| \| scaffold14851_1364778_SNP | 1364778 | A | G |
| S_9226818 \| \| scaffold14851_1365813_SNP | 1365813 | T | C |
| S_9226824 \| \| scaffold14851_1365964_SNP | 1365964 | G | C |
| S_9226826 \| \| scaffold14851_1365982_SNP | 1365982 | T | C |
| S_9226827 \| \| scaffold14851_1365983_SNP | 1365983 | C | A |
| S_9226848 \| \| scaffold14851_1366281_SNP | 1366281 | A | G |
| S_9226873 \| \| scaffold14851_1366698_SNP | 1366698 | G | A |
| S_9226887 \| \| scaffold14851_1366923_SNP | 1366923 | C | G |
| S_9226888 \| \| scaffold14851_1366925_SNP | 1366925 | G | A |
| S_9226895 \| \| scaffold14851_1366994_SNP | 1366994 | A | G |
| S_9226899 \| \| scaffold14851_1367048_SNP | 1367048 | C | A |
| S_9226902 \| \| scaffold14851_1367079_SNP | 1367079 | A | G |
| S_9226907 \| \| scaffold14851_1367106_SNP | 1367106 | G | A |
| S_9226910 \| \| scaffold14851_1367145_SNP | 1367145 | C | T |
| S_9226923 \| \| scaffold14851_1367558_SNP | 1367558 | A | G |
| scaffold14851_1368643_SNP | 1368643 | C | A |
| S_9227106 \| \| scaffold14851_1369099_SNP | 1369099 | C | T |
| S_9227107 \| \| scaffold14851_1369125_SNP | 1369125 | G | A |
| S_9227170 \| \| scaffold14851_1369834_SNP | 1369834 | G | A |
| S_9227192 \| \| scaffold14851_1370505_SNP | 1370505 | C | T |
| S_9227266 \| \| scaffold14851_1372078_SNP | 1372078 | G | A |
| S_9227272 \| \| scaffold14851_1372192_SNP | 1372192 | T | G |
| S_9227274 \| \| scaffold14851_1372207_SNP | 1372207 | T | G |
| S_9227277 \| \| scaffold14851_1372339_SNP | 1372339 | G | A |
| S_9227354 \| \| scaffold14851_1373134_SNP | 1373134 | G | A |
| S_9227355 \| \| scaffold14851_1373155_SNP | 1373155 | A | C |
| S_9227359 \| \| scaffold14851_1373212_SNP | 1373212 | T | G |
| S_9227366 \| \| scaffold14851_1373279_SNP | 1373279 | C | T |
| $_9227369 \| \| scaffold14851_1373300_SNP | 1373300 | C | T |
| S_9227378 \| \| scaffold14851_1373469_SNP | 1373469 | G | A |
| S_9227379 \| \| scaffold14851_1373474_SNP | 1373474 | G | A |
| S_9227389 \| \| scaffold14851_1373604_SNP | 1373604 | T | C |
| S_9227390 \| \| scaffold14851_1373613_SNP | 1373613 | T | G |
| S_9227391 \| \| scaffold14851_1373629_SNP | 1373629 | A | T |
| S_9227392 \| \| scaffold14851_1373632_SNP | 1373632 | C | T |
| S_9227418 \| \| scaffold14851_1373986_SNP | 1373986 | G | T |
| S_9227420 \| \| scaffold14851_1374010_SNP | 1374010 | A | T |
| S_9227421 \| \| scaffold14851_1374013_SNP | 1374013 | T | A |
| scaffold14851_1375979_SNP | 1375979 | T | C |
| S_9227947 \| \| scaffold14851_1376087_SNP | 1376087 | T | C |
| S_9227948 \| \| scaffold14851_1376088_SNP | 1376088 | T | A |
| S_9227974 \| \| scaffold14851_1376662_SNP | 1376662 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9227975 \| \| scaffold14851_1376668_SNP | 1376668 | G | A |
| S_9227982 \| \| scaffold14851_1376758_SNP | 1376758 | T | A |
| S_9227987 \| \| scaffold14851_1376811_SNP | 1376811 | T | A |
| S_9227988 \| \| scaffold14851_1376812_SNP | 1376812 | T | A |
| S_9227993 \| \| scaffold14851_1376848_SNP | 1376848 | G | C |
| S_9228020 \| \| scaffold14851_1377148_SNP | 1377148 | C | A |
| scaffold14851_1377159_SNP | 1377159 | C | T |
| S_9228035 \| \| scaffold14851_1377316_SNP | 1377316 | T | C |
| S_9228040 \| \| scaffold14851_1377372_SNP | 1377372 | G | T |
| S_9228041 \| \| scaffold14851_1377373_SNP | 1377373 | C | T |
| S_9228042 \| \| scaffold14851_1377384_SNP | 1377384 | C | G |
| S_9229225 \| \| scaffold14851_1382823_SNP | 1382823 | T | C |
| S_9229887 \| \| scaffold14851_1385532_SNP | 1385532 | T | G |
| S_9229888 \| \| scaffold14851_1385534_SNP | 1385534 | A | G |
| S_9229889 \| \| scaffold14851_1385542_SNP | 1385542 | G | A |
| S_9229890 \| \| scaffold14851_1385543_SNP | 1385543 | C | T |
| S_9229959 \| \| scaffold14851_1386056_SNP | 1386056 | G | T |
| S_9230055 \| \| scaffold14851_1386581_SNP | 1386581 | G | A |
| S_9230461 \| \| scaffold14851_1388398_SNP | 1388398 | T | C |
| S_9231206 \| \| scaffold14851_1392344_SNP | 1392344 | A | T |
| S_9231216 \| \| scaffold14851_1392461_SNP | 1392461 | G | A |
| S_9231219 \| \| scaffold14851_1392493_SNP | 1392493 | A | G |
| S_9231220 \| \| scaffold14851_1392503_SNP | 1392503 | T | C |
| S_9231289 \| \| scaffold14851_1393478_SNP | 1393478 | T | G |
| S_9231290 \| \| scaffold14851_1393525_SNP | 1393525 | C | G |
| S_9231291 \| \| scaffold14851_1393568_SNP | 1393568 | T | C |
| S_9231329 \| \| scaffold14851_1394583_SNP | 1394583 | G | A |
| S_9231330 \| \| scaffold14851_1394601_SNP | 1394601 | T | A |
| S_9231331 \| \| scaffold14851_1394613_SNP | 1394613 | G | T |
| S_9231362 \| \| scaffold14851_1394991_SNP | 1394991 | A | G |
| S_9231364 \| \| scaffold14851_1395001_SNP | 1395001 | A | C |
| S_9231365 \| \| scaffold14851_1395006_SNP | 1395006 | G | A |
| S_9231367 \| \| scaffold14851_1395030_SNP | 1395030 | A | C |
| S_9231370 \| \| scaffold14851_1395063_SNP | 1395063 | C | T |
| S_9231373 \| \| scaffold14851_1395081_SNP | 1395081 | C | T |
| S_9231389 \| \| scaffold14851_1395246_SNP | 1395246 | G | C |
| S_9231396 \| \| scaffold14851_1395323_SNP | 1395323 | T | C |
| S_9231481 \| \| scaffold14851_1396440_SNP | 1396440 | C | A |
| S_9231484 \| \| scaffold14851_1396457_SNP | 1396457 | C | T |
| S_9231499 \| \| scaffold14851_1396650_SNP | 1396650 | A | T |
| S_9231634 \| \| scaffold14851_1397510_SNP | 1397510 | T | C |
| S_9231680 \| \| scaffold14851_1397899_SNP | 1397899 | A | T |
| S_9231681 \| \| scaffold14851_1397940_SNP | 1397940 | G | A |
| S_9231682 \| \| scaffold14851_1397969_SNP | 1397969 | C | T |
| S_9231708 \| \| scaffold14851_1398215_SNP | 1398215 | T | G |
| scaffold14851_1398239_SNP | 1398239 | A | C |
| S_9231734 \| \| scaffold14851_1398498_SNP | 1398498 | A | G |
| S_9231762 \| \| scaffold14851_1398848_SNP | 1398848 | C | A |
| S_9231816 \| \| scaffold14851_1399569_SNP | 1399569 | T | C |
| S_9231819 \| \| scaffold14851_1399629_SNP | 1399629 | G | C |
| S_9231889 \| \| scaffold14851_1400675_SNP | 1400675 | C | A |
| S_9231891 \| \| scaffold14851_1400702_SNP | 1400702 | C | T |
| S_9231904 \| \| scaffold14851_1400962_SNP | 1400962 | T | C |
| S_9231911 \| \| scaffold14851_1401034_SNP | 1401034 | G | A |
| S_9231917 \| \| scaffold14851_1401085_SNP | 1401085 | G | A |
| S_9231942 \| \| scaffold14851_1401388_SNP | 1401388 | T | C |
| S_9231943 \| \| scaffold14851_1401393_SNP | 1401393 | G | A |
| S_9231949 \| \| scaffold14851_1401423_SNP | 1401423 | A | T |
| S_9231977 \| \| scaffold14851_1401760_SNP | 1401760 | G | T |
| S_9232047 \| \| scaffold14851_1402997_SNP | 1402997 | A | G |
| S_9232069 \| \| scaffold14851_1403216_SNP | 1403216 | A | C |
| S_9232071 \| \| scaffold14851_1403220_SNP | 1403220 | A | T |
| S_9232102 \| \| scaffold14851_1403685_SNP | 1403685 | T | C |
| S_9232108 \| \| scaffold14851_1403717_SNP | 1403717 | G | A |
| S_9232134 \| \| scaffold14851_1403993_SNP | 1403993 | T | C |
| S_9232139 \| \| scaffold14851_1404167_SNP | 1404167 | G | A |
| S_9232140 \| \| scaffold14851_1404170_SNP | 1404170 | A | T |
| S_9232151 \| \| scaffold14851_1404292_SNP | 1404292 | A | G |
| S_9232167 \| \| scaffold14851_1404527_SNP | 1404527 | A | T |
| S_9232175 \| \| scaffold14851_1404592_SNP | 1404592 | A | T |
| S_9232189 \| \| scaffold14851_1404733_SNP | 1404733 | T | C |
| S_9232190 \| \| scaffold14851_1404734_SNP | 1404734 | C | A |
| S_9232191 \| \| scaffold14851_1404737_SNP | 1404737 | G | T |
| S_9232208 \| \| scaffold14851_1404953_SNP | 1404953 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9232234 \| \| scaffold14851_1405317_SNP | 1405317 | C | T |
| S_9232245 \| \| scaffold14851_1405401_SNP | 1405401 | A | T |
| S_9232270 \| \| scaffold14851_1406221_SNP | 1406221 | G | C |
| S_9232271 \| \| scaffold14851_1406222_SNP | 1406222 | A | G |
| S_9232272 \| \| scaffold14851_1406225_SNP | 1406225 | G | A |
| scaffold14851_1407693_SNP | 1407693 | G | A |
| S_9232330 \| \| scaffold14851_1407728_SNP | 1407728 | T | A |
| S_9232332 \| \| scaffold14851_1407773_SNP | 1407773 | A | C |
| S_9232337 \| \| scaffold14851_1407829_SNP | 1407829 | A | G |
| S_9232338 \| \| scaffold14851_1407867_SNP | 1407867 | C | A |
| S_9232370 \| \| scaffold14851_1408419_SNP | 1408419 | G | A |
| S_9232371 \| \| scaffold14851_1408425_SNP | 1408425 | G | A |
| S_9232372 \| \| scaffold14851_1408434_SNP | 1408434 | C | G |
| S_9232377 \| \| scaffold14851_1408459_SNP | 1408459 | C | T |
| S_9232748 \| \| scaffold14851_1410756_SNP | 1410756 | A | C |
| S_9233112 \| \| scaffold14851_1413280_SNP | 1413280 | T | G |
| S_9234372 \| \| scaffold14851_1421352_SNP | 1421352 | C | T |
| S_9234410 \| \| scaffold14851_1422064_SNP | 1422064 | A | T |
| S_9234421 \| \| scaffold14851_1422202_SNP | 1422202 | T | C |
| S_9234428 \| \| scaffold14851_1422324_SNP | 1422324 | G | A |
| S_9234450 \| \| scaffold14851_1422591_SNP | 1422591 | A | T |
| S_9234489 \| \| scaffold14851_1423178_SNP | 1423178 | T | C |
| S_9234495 \| \| scaffold14851_1423231_SNP | 1423231 | T | C |
| S_9234498 \| \| scaffold14851_1423257_SNP | 1423257 | C | T |
| S_9234499 \| \| scaffold14851_1423258_SNP | 1423258 | A | T |
| S_9234517 \| \| scaffold14851_1423500_SNP | 1423500 | G | T |
| S_9234524 \| \| scaffold14851_1423629_SNP | 1423629 | C | G |
| S_9234537 \| \| scaffold14851_1423765_SNP | 1423765 | T | G |
| S_9234538 \| \| scaffold14851_1423772_SNP | 1423772 | T | G |
| S_9234539 \| \| scaffold14851_1423803_SNP | 1423803 | C | G |
| S_9234546 \| \| scaffold14851_1423864_SNP | 1423864 | C | A |
| S_9234547 \| \| scaffold14851_1423872_SNP | 1423872 | A | C |
| S_9234549 \| \| scaffold14851_1423945_SNP | 1423945 | C | T |
| S_9234551 \| \| scaffold14851_1423958_SNP | 1423958 | T | G |
| S_9234557 \| \| scaffold14851_1424172_SNP | 1424172 | A | C |
| S_9234568 \| \| scaffold14851_1424377_SNP | 1424377 | T | C |
| S_9234581 \| \| scaffold14851_1424447_SNP | 1424447 | G | C |
| S_9234582 \| \| scaffold14851_1424453_SNP | 1424453 | G | A |
| S_9234584 \| \| scaffold14851_1424514_SNP | 1424514 | G | T |
| S_9234713 \| \| scaffold14851_1426533_SNP | 1426533 | G | T |
| S_9235159 \| \| scaffold14851_1428816_SNP | 1428816 | T | A |
| S_9235428 \| \| scaffold14851_1432236_SNP | 1432236 | T | C |
| S_9235454 \| \| scaffold14851_1432586_SNP | 1432586 | T | G |
| S_9235515 \| \| scaffold14851_1432708_SNP | 1432708 | G | A |
| scaffold14851_1432762_SNP | 1432762 | A | G |
| S_9235527 \| \| scaffold14851_1432800_SNP | 1432800 | G | A |
| scaffold14851_1432836_SNP | 1432836 | C | T |
| S_9235534 \| \| scaffold14851_1432860_SNP | 1432860 | G | A |
| S_9235603 \| \| scaffold14851_1433924_SNP | 1433924 | G | T |
| scaffold14851_1434111_SNP | 1434111 | T | C |
| S_9235654 \| \| scaffold14851_1434269_SNP | 1434269 | C | T |
| S_9235659 \| \| scaffold14851_1434328_SNP | 1434328 | C | T |
| S_9235667 \| \| scaffold14851_1434619_SNP | 1434619 | C | A |
| S_9235671 \| \| scaffold14851_1434676_SNP | 1434676 | C | T |
| S_9235673 \| \| scaffold14851_1434706_SNP | 1434706 | G | T |
| S_9235685 \| \| scaffold14851_1434765_SNP | 1434765 | A | G |
| S_9235758 \| \| scaffold14851_1435682_SNP | 1435682 | A | C |
| S_9235774 \| \| scaffold14851_1435938_SNP | 1435938 | G | T |
| S_9235789 \| \| scaffold14851_1436255_SNP | 1436255 | T | C |
| S_9235795 \| \| scaffold14851_1436357_SNP | 1436357 | T | C |
| S_9235798 \| \| scaffold14851_1436398_SNP | 1436398 | G | A |
| S_9235803 \| \| scaffold14851_1436440_SNP | 1436440 | G | C |
| S_9235809 \| \| scaffold14851_1436480_SNP | 1436480 | A | C |
| S_9235811 \| \| scaffold14851_1436490_SNP | 1436490 | G | A |
| S_9235813 \| \| scaffold14851_1436519_SNP | 1436519 | C | G |
| S_9235825 \| \| scaffold14851_1436683_SNP | 1436683 | T | C |
| S_9235826 \| \| scaffold14851_1436690_SNP | 1436690 | A | T |
| S_9235873 \| \| scaffold14851_1437454_SNP | 1437454 | G | C |
| S_9235899 \| \| scaffold14851_1438016_SNP | 1438016 | A | C |
| S_9235900 \| \| scaffold14851_1438017_SNP | 1438017 | T | C |
| S_9235933 \| \| scaffold14851_1438267_SNP | 1438267 | A | G |
| S_9235949 \| \| scaffold14851_1438320_SNP | 1438320 | G | A |
| S_9236018 \| \| scaffold14851_1438563_SNP | 1438563 | T | C |
| S_9236020 \| \| scaffold14851_1438587_SNP | 1438587 | T | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9236023 \| \| scaffold14851_1438611_SNP | 1438611 | C | T |
| S_9236106 \| \| scaffold14851_1439832_SNP | 1439832 | G | T |
| scaffold14851_1440164_SNP | 1440164 | G | A |
| S_9236352 \| \| scaffold14851_1446359_SNP | 1446359 | C | T |
| S_9236355 \| \| scaffold14851_1446398_SNP | 1446398 | A | G |
| S_9236713 \| \| scaffold14851_1448268_SNP | 1448268 | T | C |
| S_9237471 \| \| scaffold14851_1451613_SNP | 1451613 | C | T |
| scaffold14851_1452914_SNP | 1452914 | A | G |
| scaffold14851_1453652_SNP | 1453652 | C | G |
| S_9237971 \| \| scaffold14851_1456302_SNP | 1456302 | C | T |
| S_9238375 \| \| scaffold14851_1458563_SNP | 1458563 | A | G |
| S_9238505 \| \| scaffold14851_1460326_SNP | 1460326 | A | G |
| S_9238507 \| \| scaffold14851_1460352_SNP | 1460352 | G | A |
| S_9238555 \| \| scaffold14851_1460575_SNP | 1460575 | A | G |
| S_9238556 \| \| scaffold14851_1460604_SNP | 1460604 | C | T |
| S_9238589 \| \| scaffold14851_1460838_SNP | 1460838 | A | G |
| S_9238590 \| \| scaffold14851_1460839_SNP | 1460839 | G | T |
| S_9238603 \| \| scaffold14851_1460918_SNP | 1460918 | A | C |
| S_9238610 \| \| scaffold14851_1461034_SNP | 1461034 | T | C |
| S_9238630 \| \| scaffold14851_1461202_SNP | 1461202 | A | C |
| S_9238632 \| \| scaffold14851_1461213_SNP | 1461213 | A | G |
| S_9238642 \| \| scaffold14851_1461333_SNP | 1461333 | C | G |
| S_9238776 \| \| scaffold14851_1462030_SNP | 1462030 | A | T |
| S_9238818 \| \| scaffold14851_1462206_SNP | 1462206 | T | C |
| S_9238826 \| \| scaffold14851_1462309_SNP | 1462309 | G | A |
| S_9238862 \| \| scaffold14851_1462681_SNP | 1462681 | A | T |
| S_9238881 \| \| scaffold14851_1462810_SNP | 1462810 | A | G |
| S_9238887 \| \| scaffold14851_1462909_SNP | 1462909 | T | C |
| S_9238929 \| \| scaffold14851_1463174_SNP | 1463174 | T | G |
| S_9239018 \| \| scaffold14851_1463656_SNP | 1463656 | G | A |
| S_9239021 \| \| scaffold14851_1463690_SNP | 1463690 | C | T |
| S_9239030 \| \| scaffold14851_1463743_SNP | 1463743 | A | G |
| S_9239048 \| \| scaffold14851_1463881_SNP | 1463881 | A | C |
| S_9239049 \| \| scaffold14851_1463907_SNP | 1463907 | C | T |
| S_9239071 \| \| scaffold14851_1464042_SNP | 1464042 | T | C |
| S_9239080 \| \| scaffold14851_1464084_SNP | 1464084 | A | G |
| S_9239158 \| \| scaffold14851_1464325_SNP | 1464325 | G | A |
| S_9239159 \| \| scaffold14851_1464326_SNP | 1464326 | G | A |
| S_9239210 \| \| scaffold14851_1464838_SNP | 1464838 | G | A |
| S_9239214 \| \| scaffold14851_1464867_SNP | 1464867 | T | C |
| S_9239335 \| \| scaffold14851_1465983_SNP | 1465983 | A | C |
| S_9239373 \| \| scaffold14851_1466431_SNP | 1466431 | G | C |
| S_9239664 \| \| scaffold14851_1469269_SNP | 1469269 | A | G |
| S_9239684 \| \| scaffold14851_1469529_SNP | 1469529 | C | A |
| S_9239739 \| \| scaffold14851_1470067_SNP | 1470067 | T | A |
| S_9239763 \| \| scaffold14851_1470311_SNP | 1470311 | G | A |
| S_9239776 \| \| scaffold14851_1470467_SNP | 1470467 | T | C |
| S_9240145 \| \| scaffold14851_1476109_SNP | 1476109 | G | T |
| S_9240157 \| \| scaffold14851_1476240_SNP | 1476240 | T | A |
| S_9240159 \| \| scaffold14851_1476289_SNP | 1476289 | A | G |
| S_9240161 \| \| scaffold14851_1476294_SNP | 1476294 | G | A |
| S_9240168 \| \| scaffold14851_1476424_SNP | 1476424 | C | A |
| S_9240169 \| \| scaffold14851_1476429_SNP | 1476429 | T | A |
| S_9240193 \| \| scaffold14851_1476656_SNP | 1476656 | G | T |
| S_9240195 \| \| scaffold14851_1476684_SNP | 1476684 | G | A |
| S_9240245 \| \| scaffold14851_1477786_SNP | 1477786 | G | A |
| S_9240248 \| \| scaffold14851_1477810_SNP | 1477810 | C | T |
| S_9240256 \| \| scaffold14851_1477986_SNP | 1477986 | T | C |
| S_9240258 \| \| scaffold14851_1477995_SNP | 1477995 | A | T |
| S_9240263 \| \| scaffold14851_1478084_SNP | 1478084 | A | G |
| S_9240264 \| \| scaffold14851_1478088_SNP | 1478088 | T | C |
| S_9240265 \| \| scaffold14851_1478103_SNP | 1478103 | C | T |
| S_9240287 \| \| scaffold14851_1478369_SNP | 1478369 | C | T |
| S_9240358 \| \| scaffold14851_1478729_SNP | 1478729 | A | G |
| S_9240443 \| \| scaffold14851_1481936_SNP | 1481936 | A | T |
| S_9240448 \| \| scaffold14851_1481975_SNP | 1481975 | C | G |
| S_9240453 \| \| scaffold14851_1482023_SNP | 1482023 | C | T |
| S_9240457 \| \| scaffold14851_1482078_SNP | 1482078 | A | G |
| S_9240460 \| \| scaffold14851_1482122_SNP | 1482122 | T | C |
| S_9240477 \| \| scaffold14851_1482339_SNP | 1482339 | A | G |
| S_9240481 \| \| scaffold14851_1482440_SNP | 1482440 | T | A |
| S_9240667 \| \| scaffold14851_1484512_SNP | 1484512 | G | T |
| S_9240669 \| \| scaffold14851_1484579_SNP | 1484579 | A | C |
| S_9240670 \| \| scaffold14851_1484588_SNP | 1484588 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9240671 \| \| scaffold14851_1484589_SNP | 1484589 | C | T |
| S_9240674 \| \| scaffold14851_1484658_SNP | 1484658 | C | T |
| S_9240720 \| \| scaffold14851_1485017_SNP | 1485017 | G | A |
| S_9240751 \| \| scaffold14851_1485360_SNP | 1485360 | C | G |
| S_9240763 \| \| scaffold14851_1485478_SNP | 1485478 | T | G |
| S_9240767 \| \| scaffold14851_1485572_SNP | 1485572 | C | T |
| S_9240768 \| \| scaffold14851_1485577_SNP | 1485577 | C | A |
| S_9240770 \| \| scaffold14851_1485595_SNP | 1485595 | C | G |
| S_9240771 \| \| scaffold14851_1485599_SNP | 1485599 | G | A |
| S_9240778 \| \| scaffold14851_1485795_SNP | 1485795 | G | T |
| S_9240780 \| \| scaffold14851_1485823_SNP | 1485823 | A | G |
| S_9240785 \| \| scaffold14851_1485858_SNP | 1485858 | G | A |
| S_9240786 \| \| scaffold14851_1485871_SNP | 1485871 | A | G |
| S_9240802 \| \| scaffold14851_1486143_SNP | 1486143 | C | A |
| S_9240807 \| \| scaffold14851_1486272_SNP | 1486272 | G | A |
| S_9240810 \| \| scaffold14851_1486291_SNP | 1486291 | G | A |
| S_9240874 \| \| scaffold14851_1487263_SNP | 1487263 | A | C |
| S_9240875 \| \| scaffold14851_1487290_SNP | 1487290 | G | A |
| S_9240876 \| \| scaffold14851_1487304_SNP | 1487304 | C | T |
| S_9240877 \| \| scaffold14851_1487319_SNP | 1487319 | C | A |
| S_9240892 \| \| scaffold14851_1487650_SNP | 1487650 | C | T |
| S_9240904 \| \| scaffold14851_1487850_SNP | 1487850 | G | A |
| S_9240939 \| \| scaffold14851_1488246_SNP | 1488246 | C | T |
| S_9240944 \| \| scaffold14851_1488409_SNP | 1488409 | T | C |
| S_9240950 \| \| scaffold14851_1488609_SNP | 1488609 | C | T |
| S_9240955 \| \| scaffold14851_1488683_SNP | 1488683 | T | C |
| S_9240964 \| \| scaffold14851_1488924_SNP | 1488924 | A | G |
| S_9240966 \| \| scaffold14851_1488957_SNP | 1488957 | C | A |
| S_9240975 \| \| scaffold14851_1489088_SNP | 1489088 | C | T |
| S_9240977 \| \| scaffold14851_1489102_SNP | 1489102 | G | A |
| S_9240987 \| \| scaffold14851_1489337_SNP | 1489337 | A | T |
| S_9241004 \| \| scaffold14851_1489605_SNP | 1489605 | C | A |
| S_9241045 \| \| scaffold14851_1490074_SNP | 1490074 | A | G |
| S_9241048 \| \| scaffold14851_1490109_SNP | 1490109 | T | G |
| S_9241059 \| \| scaffold14851_1490262_SNP | 1490262 | C | T |
| S_9241323 \| \| scaffold14851_1493545_SNP | 1493545 | C | T |
| S_9241394 \| \| scaffold14851_1494115_SNP | 1494115 | C | T |
| S_9241395 \| \| scaffold14851_1494132_SNP | 1494132 | A | T |
| S_9241433 \| \| scaffold14851_1494634_SNP | 1494634 | A | C |
| S_9241437 \| \| scaffold14851_1494687_SNP | 1494687 | C | A |
| S_9241439 \| \| scaffold14851_1494709_SNP | 1494709 | T | A |
| S_9241443 \| \| scaffold14851_1494760_SNP | 1494760 | C | T |
| S_9241579 \| \| scaffold14851_1496371_SNP | 1496371 | T | C |
| S_9241602 \| \| scaffold14851_1496535_SNP | 1496535 | G | T |
| S_9241690 \| \| scaffold14851_1497996_SNP | 1497996 | T | G |
| S_9241759 \| \| scaffold14851_1499285_SNP | 1499285 | A | G |
| S_9241762 \| \| scaffold14851_1499374_SNP | 1499374 | A | G |
| S_9241770 \| \| scaffold14851_1499462_SNP | 1499462 | T | A |
| S_9241845 \| \| scaffold14851_1500275_SNP | 1500275 | G | T |
| S_9241850 \| \| scaffold14851_1500313_SNP | 1500313 | G | A |
| S_9241900 \| \| scaffold14851_1500841_SNP | 1500841 | T | C |
| S_9242026 \| \| scaffold14851_1502925_SNP | 1502925 | A | T |
| S_9242027 \| \| scaffold14851_1502931_SNP | 1502931 | G | A |
| S_9242133 \| \| scaffold14851_1504504_SNP | 1504504 | A | T |
| S_9242164 \| \| scaffold14851_1505009_SNP | 1505009 | C | T |
| S_9242309 \| \| scaffold14851_1506409_SNP | 1506409 | G | T |
| S_9242328 \| \| scaffold14851_1506805_SNP | 1506805 | T | C |
| S_9242410 \| \| scaffold14851_1508069_SNP | 1508069 | C | T |
| S_9242413 \| \| scaffold14851_1508246_SNP | 1508246 | A | T |
| S_9242474 \| \| scaffold14851_1509238_SNP | 1509238 | T | C |
| S_9242641 \| \| scaffold14851_1511000_SNP | 1511000 | T | A |
| S_9242656 \| \| scaffold14851_1511089_SNP | 1511089 | A | G |
| S_9242659 \| \| scaffold14851_1511144_SNP | 1511144 | T | C |
| S_9242662 \| \| scaffold14851_1511231_SNP | 1511231 | C | G |
| S_9242955 \| \| scaffold14851_1514683_SNP | 1514683 | C | A |
| S_9242962 \| \| scaffold14851_1514755_SNP | 1514755 | C | T |
| S_9243056 \| \| scaffold14851_1515364_SNP | 1515364 | A | T |
| S_9243057 \| \| scaffold14851_1515390_SNP | 1515390 | T | C |
| S_9243168 \| \| scaffold14851_1516205_SNP | 1516205 | A | C |
| S_9243410 \| \| scaffold14851_1519267_SNP | 1519267 | C | T |
| S_9243527 \| \| scaffold14851_1520827_SNP | 1520827 | C | T |
| S_9243617 \| \| scaffold14851_1522082_SNP | 1522082 | T | C |
| S_9243626 \| \| scaffold14851_1522239_SNP | 1522239 | T | C |
| S_9243627 \| \| scaffold14851_1522338_SNP | 1522338 | T | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9243647 \| \| scaffold14851_1522857_SNP | 1522857 | G | A |
| S_9243652 \| \| scaffold14851_1522896_SNP | 1522896 | A | G |
| S_9243815 \| \| scaffold14851_1525044_SNP | 1525044 | G | C |
| S_9243961 \| \| scaffold14851_1526854_SNP | 1526854 | C | T |
| S_9243965 \| \| scaffold14851_1526941_SNP | 1526941 | T | C |
| S_9244271 \| \| scaffold14851_1530748_SNP | 1530748 | C | G |
| S_9244282 \| \| scaffold14851_1530857_SNP | 1530857 | T | A |
| S_9244459 \| \| scaffold14851_1533444_SNP | 1533444 | T | C |
| S_9244751 \| \| scaffold14851_1538081_SNP | 1538081 | C | G |
| S_9244861 \| \| scaffold14851_1539563_SNP | 1539563 | G | A |
| S_9244863 \| \| scaffold14851_1539570_SNP | 1539570 | A | T |
| S_9244865 \| \| scaffold14851_1539580_SNP | 1539580 | A | C |
| S_9244911 \| \| scaffold14851_1540031_SNP | 1540031 | A | G |
| S_9244945 \| \| scaffold14851_1540407_SNP | 1540407 | T | C |
| S_9244974 \| \| scaffold14851_1540718_SNP | 1540718 | G | T |
| S_9245015 \| \| scaffold14851_1541140_SNP | 1541140 | G | A |
| S_9245016 \| \| scaffold14851_1541191_SNP | 1541191 | T | C |
| S_9245190 \| \| scaffold14851_1542926_SNP | 1542926 | C | A |
| S_9245191 \| \| scaffold14851_1542927_SNP | 1542927 | C | A |
| S_9245229 \| \| scaffold14851_1543119_SNP | 1543119 | G | A |
| S_9245513 \| \| scaffold14851_1547395_SNP | 1547395 | A | T |
| S_9245587 \| \| scaffold14851_1548502_SNP | 1548502 | G | T |
| S_9245638 \| \| scaffold14851_1548934_SNP | 1548934 | C | T |
| S_9245794 \| \| scaffold14851_1550460_SNP | 1550460 | G | C |
| S_9245806 \| \| scaffold14851_1550536_SNP | 1550536 | C | T |
| S_9245979 \| \| scaffold14851_1553133_SNP | 1553133 | G | A |
| S_9245980 \| \| scaffold14851_1553138_SNP | 1553138 | G | A |
| S_9246037 \| \| scaffold14851_1554096_SNP | 1554096 | A | C |
| S_9246039 \| \| scaffold14851_1554140_SNP | 1554140 | C | G |
| S_9246202 \| \| scaffold14851_1555907_SNP | 1555907 | T | G |
| S_9246503 \| \| scaffold14851_1559470_SNP | 1559470 | T | A |
| S_9246527 \| \| scaffold14851_1559835_SNP | 1559835 | T | C |
| S_9247566 \| \| scaffold14851_1571303_SNP | 1571303 | T | C |
| S_9247568 \| \| scaffold14851_1571305_SNP | 1571305 | T | A |
| S_9247621 \| \| scaffold14851_1571950_SNP | 1571950 | C | T |
| S_9247914 \| \| scaffold14851_1575761_SNP | 1575761 | T | G |
| S_9247921 \| \| scaffold14851_1575892_SNP | 1575892 | G | T |
| S_9248129 \| \| scaffold14851_1578539_SNP | 1578539 | G | A |
| S_9248135 \| \| scaffold14851_1578649_SNP | 1578649 | T | G |
| S_9248220 \| \| scaffold14851_1580050_SNP | 1580050 | T | A |
| S_9248221 \| \| scaffold14851_1580072_SNP | 1580072 | G | A |
| S_9248258 \| \| scaffold14851_1580715_SNP | 1580715 | C | A |
| S_9248305 \| \| scaffold14851_1581417_SNP | 1581417 | A | T |
| S_9248310 \| \| scaffold14851_1581457_SNP | 1581457 | A | G |
| S_9248323 \| \| scaffold14851_1581727_SNP | 1581727 | T | A |
| S_9248349 \| \| scaffold14851_1582132_SNP | 1582132 | A | G |
| S_9248437 \| \| scaffold14851_1582955_SNP | 1582955 | T | A |
| S_9248481 \| \| scaffold14851_1583528_SNP | 1583528 | G | A |
| S_9248512 \| \| scaffold14851_1583892_SNP | 1583892 | G | A |
| S_9248536 \| \| scaffold14851_1584095_SNP | 1584095 | A | G |
| S_9248538 \| \| scaffold14851_1584121_SNP | 1584121 | G | C |
| S_9248739 \| \| scaffold14851_1586983_SNP | 1586983 | A | T |
| S_9248741 \| \| scaffold14851_1587019_SNP | 1587019 | T | C |
| S_9248746 \| \| scaffold14851_1587068_SNP | 1587068 | A | G |
| S_9248771 \| \| scaffold14851_1587358_SNP | 1587358 | T | C |
| S_9248782 \| \| scaffold14851_1587580_SNP | 1587580 | G | A |
| S_9248828 \| \| scaffold14851_1588933_SNP | 1588933 | G | T |
| S_9248830 \| \| scaffold14851_1588945_SNP | 1588945 | A | T |
| S_9248839 \| \| scaffold14851_1589138_SNP | 1589138 | T | C |
| S_9248871 \| \| scaffold14851_1589375_SNP | 1589375 | T | C |
| S_9248872 \| \| scaffold14851_1589388_SNP | 1589388 | C | T |
| S_9249024 \| \| scaffold14851_1591794_SNP | 1591794 | G | A |
| S_9249243 \| \| scaffold14851_1593263_SNP | 1593263 | T | A |
| S_9249272 \| \| scaffold14851_1594159_SNP | 1594159 | T | G |
| S_9249288 \| \| scaffold14851_1594345_SNP | 1594345 | T | G |
| S_9249349 \| \| scaffold14851_1595271_SNP | 1595271 | G | A |
| S_9249356 \| \| scaffold14851_1595396_SNP | 1595396 | T | C |
| S_9249357 \| \| scaffold14851_1595398_SNP | 1595398 | G | T |
| S_9249369 \| \| scaffold14851_1595528_SNP | 1595528 | A | G |
| S_9249372 \| \| scaffold14851_1595553_SNP | 1595553 | G | T |
| S_9249377 \| \| scaffold14851_1595709_SNP | 1595709 | T | G |
| S_9249380 \| \| scaffold14851_1595765_SNP | 1595765 | C | T |
| S_9249381 \| \| scaffold14851_1595777_SNP | 1595777 | A | G |
| S_9249383 \| \| scaffold14851_1595787_SNP | 1595787 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9249388 \| \| scaffold14851_1595812_SNP | 1595812 | T | C |
| S_9249511 \| \| scaffold14851_1597279_SNP | 1597279 | A | G |
| S_9249512 \| \| scaffold14851_1597314_SNP | 1597314 | T | C |
| S_9249514 \| \| scaffold14851_1597342_SNP | 1597342 | T | A |
| S_9249541 \| \| scaffold14851_1597752_SNP | 1597752 | G | A |
| S_9249542 \| \| scaffold14851_1597753_SNP | 1597753 | C | T |
| S_9249543 \| \| scaffold14851_1597772_SNP | 1597772 | C | A |
| S_9249548 \| \| scaffold14851_1597918_SNP | 1597918 | T | A |
| S_9249549 \| \| scaffold14851_1597919_SNP | 1597919 | G | A |
| S_9249611 \| \| scaffold14851_1598945_SNP | 1598945 | A | C |
| S_9249621 \| \| scaffold14851_1599159_SNP | 1599159 | T | G |
| S_9249622 \| \| scaffold14851_1599185_SNP | 1599185 | G | A |
| S_9249624 \| \| scaffold14851_1599198_SNP | 1599198 | G | A |
| S_9249649 \| \| scaffold14851_1599655_SNP | 1599655 | T | G |
| S_9249659 \| \| scaffold14851_1599841_SNP | 1599841 | T | A |
| S_9249673 \| \| scaffold14851_1600196_SNP | 1600196 | C | A |
| S_9249704 \| \| scaffold14851_1600623_SNP | 1600623 | T | G |
| S_9249709 \| \| scaffold14851_1600695_SNP | 1600695 | T | A |
| S_9249710 \| \| scaffold14851_1600697_SNP | 1600697 | A | T |
| S_9249711 \| \| scaffold14851_1600698_SNP | 1600698 | A | T |
| S_9249712 \| \| scaffold14851_1600724_SNP | 1600724 | T | G |
| S_9249713 \| \| scaffold14851_1600735_SNP | 1600735 | G | A |
| S_9249751 \| \| scaffold14851_1601342_SNP | 1601342 | T | A |
| S_9249883 \| \| scaffold14851_1603645_SNP | 1603645 | G | T |
| S_9249923 \| \| scaffold14851_1604186_SNP | 1604186 | A | T |
| S_9249949 \| \| scaffold14851_1604783_SNP | 1604783 | G | T |
| S_9249980 \| \| scaffold14851_1605161_SNP | 1605161 | G | A |
| S_9249983 \| \| scaffold14851_1605192_SNP | 1605192 | C | G |
| S_9250021 \| \| scaffold14851_1605645_SNP | 1605645 | A | G |
| S_9250023 \| \| scaffold14851_1605664_SNP | 1605664 | A | G |
| S_9250035 \| \| scaffold14851_1606036_SNP | 1606036 | G | C |
| S_9250044 \| \| scaffold14851_1606158_SNP | 1606158 | G | A |
| S_9250089 \| \| scaffold14851_1606913_SNP | 1606913 | T | C |
| S_9250171 \| \| scaffold14851_1608816_SNP | 1608816 | A | T |
| S_9250264 \| \| scaffold14851_1610206_SNP | 1610206 | T | A |
| S_9250266 \| \| scaffold14851_1610208_SNP | 1610208 | C | T |
| S_9250267 \| \| scaffold14851_1610210_SNP | 1610210 | A | G |
| S_9250268 \| \| scaffold14851_1610220_SNP | 1610220 | G | A |
| S_9250271 \| \| scaffold14851_1610346_SNP | 1610346 | C | A |
| S_9250308 \| \| scaffold14851_1610762_SNP | 1610762 | A | G |
| S_9250310 \| \| scaffold14851_1610790_SNP | 1610790 | T | G |
| S_9250334 \| \| scaffold14851_1611232_SNP | 1611232 | G | T |
| S_9250335 \| \| scaffold14851_1611235_SNP | 1611235 | T | C |
| S_9250337 \| \| scaffold14851_1611253_SNP | 1611253 | T | A |
| S_9250339 \| \| scaffold14851_1611292_SNP | 1611292 | G | A |
| S_9250435 \| \| scaffold14851_1611736_SNP | 1611736 | T | A |
| S_9250455 \| \| scaffold14851_1612052_SNP | 1612052 | A | T |
| S_9250456 \| \| scaffold14851_1612054_SNP | 1612054 | T | A |
| S_9250472 \| \| scaffold14851_1612310_SNP | 1612310 | A | G |
| S_9250474 \| \| scaffold14851_1612385_SNP | 1612385 | C | T |
| S_9250483 \| \| scaffold14851_1612634_SNP | 1612634 | A | C |
| S_9250493 \| \| scaffold14851_1612756_SNP | 1612756 | C | G |
| S_9250495 \| \| scaffold14851_1612797_SNP | 1612797 | G | T |
| S_9250498 \| \| scaffold14851_1612831_SNP | 1612831 | A | T |
| S_9250505 \| \| scaffold14851_1612930_SNP | 1612930 | G | T |
| S_9250517 \| \| scaffold14851_1613154_SNP | 1613154 | C | A |
| S_9250533 \| \| scaffold14851_1613300_SNP | 1613300 | G | A |
| S_9250535 \| \| scaffold14851_1613334_SNP | 1613334 | G | A |
| S_9250553 \| \| scaffold14851_1613585_SNP | 1613585 | T | G |
| S_9250564 \| \| scaffold14851_1613695_SNP | 1613695 | T | G |
| S_9250572 \| \| scaffold14851_1613757_SNP | 1613757 | C | T |
| S_9250578 \| \| scaffold14851_1613835_SNP | 1613835 | A | C |
| S_9250579 \| \| scaffold14851_1613845_SNP | 1613845 | C | T |
| S_9250583 \| \| scaffold14851_1613869_SNP | 1613869 | C | G |
| S_9250590 \| \| scaffold14851_1613963_SNP | 1613963 | A | G |
| S_9250599 \| \| scaffold14851_1614247_SNP | 1614247 | G | A |
| S_9250602 \| \| scaffold14851_1614263_SNP | 1614263 | A | G |
| S_9250608 \| \| scaffold14851_1614276_SNP | 1614276 | A | T |
| S_9250633 \| \| scaffold14851_1614745_SNP | 1614745 | T | A |
| S_9250665 \| \| scaffold14851_1615194_SNP | 1615194 | A | C |
| S_9250831 \| \| scaffold14851_1617491_SNP | 1617491 | T | A |
| S_9250838 \| \| scaffold14851_1617656_SNP | 1617656 | T | C |
| S_9250839 \| \| scaffold14851_1617673_SNP | 1617673 | A | G |
| S_9250867 \| \| scaffold14851_1618148_SNP | 1618148 | T | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9250877 \| \| scaffold14851_1618341_SNP | 1618341 | T | A |
| S_9250878 \| \| scaffold14851_1618351_SNP | 1618351 | G | T |
| S_9250881 \| \| scaffold14851_1618395_SNP | 1618395 | A | G |
| S_9250895 \| \| scaffold14851_1618664_SNP | 1618664 | G | A |
| S_9250904 \| \| scaffold14851_1618771_SNP | 1618771 | T | G |
| S_9250905 \| \| scaffold14851_1618780_SNP | 1618780 | C | A |
| S_9250906 \| \| scaffold14851_1618799_SNP | 1618799 | C | T |
| S_9250913 \| \| scaffold14851_1618989_SNP | 1618989 | A | T |
| S_9250925 \| \| scaffold14851_1619213_SNP | 1619213 | A | G |
| S_9250936 \| \| scaffold14851_1619489_SNP | 1619489 | C | T |
| S_9250943 \| \| scaffold14851_1619516_SNP | 1619516 | T | A |
| S_9250947 \| \| scaffold14851_1619562_SNP | 1619562 | G | A |
| S_9250952 \| \| scaffold14851_1619659_SNP | 1619659 | C | T |
| S_9250953 \| \| scaffold14851_1619677_SNP | 1619677 | A | C |
| S_9250960 \| \| scaffold14851_1619767_SNP | 1619767 | A | C |
| S_9250967 \| \| scaffold14851_1619805_SNP | 1619805 | T | A |
| S_9250976 \| \| scaffold14851_1619899_SNP | 1619899 | C | T |
| S_9251008 \| \| scaffold14851_1620436_SNP | 1620436 | G | A |
| S_9251018 \| \| scaffold14851_1620603_SNP | 1620603 | A | C |
| S_9251033 \| \| scaffold14851_1620827_SNP | 1620827 | G | C |
| S_9251042 \| \| scaffold14851_1620946_SNP | 1620946 | A | G |
| S_9251052 \| \| scaffold14851_1621155_SNP | 1621155 | G | A |
| S_9251193 \| \| scaffold14851_1622276_SNP | 1622276 | T | C |
| S_9251198 \| \| scaffold14851_1622328_SNP | 1622328 | G | A |
| S_9251199 \| \| scaffold14851_1622334_SNP | 1622334 | C | A |
| S_9251218 \| \| scaffold14851_1622650_SNP | 1622650 | C | T |
| S_9251307 \| \| scaffold14851_1624103_SNP | 1624103 | C | T |
| S_9251399 \| \| scaffold14851_1625223_SNP | 1625223 | G | A |
| S_9251404 \| \| scaffold14851_1625350_SNP | 1625350 | A | C |
| S_9251422 \| \| scaffold14851_1625460_SNP | 1625460 | A | G |
| S_9251424 \| \| scaffold14851_1625514_SNP | 1625514 | G | T |
| S_9251467 \| \| scaffold14851_1626715_SNP | 1626715 | G | A |
| S_9251474 \| \| scaffold14851_1626798_SNP | 1626798 | G | A |
| S_9251591 \| \| scaffold14851_1629456_SNP | 1629456 | T | G |
| S_9251597 \| \| scaffold14851_1629499_SNP | 1629499 | G | C |
| S_9251610 \| \| scaffold14851_1629634_SNP | 1629634 | A | T |
| S_9251613 \| \| scaffold14851_1629667_SNP | 1629667 | G | C |
| S_9251620 \| \| scaffold14851_1629854_SNP | 1629854 | C | G |
| S_9251621 \| \| scaffold14851_1629864_SNP | 1629864 | C | A |
| S_9251625 \| \| scaffold14851_1629911_SNP | 1629911 | G | C |
| S_9251665 \| \| scaffold14851_1630829_SNP | 1630829 | A | C |
| S_9251706 \| \| scaffold14851_1631383_SNP | 1631383 | A | G |
| S_9251708 \| \| scaffold14851_1631429_SNP | 1631429 | A | T |
| S_9251727 \| \| scaffold14851_1631795_SNP | 1631795 | C | T |
| S_9251769 \| \| scaffold14851_1631944_SNP | 1631944 | G | A |
| S_9251770 \| \| scaffold14851_1631951_SNP | 1631951 | G | A |
| S_9251773 \| \| scaffold14851_1632015_SNP | 1632015 | C | T |
| S_9251805 \| \| scaffold14851_1632596_SNP | 1632596 | A | T |
| S_9251817 \| \| scaffold14851_1632731_SNP | 1632731 | A | G |
| S_9251826 \| \| scaffold14851_1632938_SNP | 1632938 | G | A |
| S_9251830 \| \| scaffold14851_1633018_SNP | 1633018 | A | C |
| S_9251831 \| \| scaffold14851_1633021_SNP | 1633021 | G | A |
| S_9251832 \| \| scaffold14851_1633046_SNP | 1633046 | G | A |
| S_9251857 \| \| scaffold14851_1633510_SNP | 1633510 | G | T |
| S_9251860 \| \| scaffold14851_1633526_SNP | 1633526 | A | T |
| S_9251955 \| \| scaffold14851_1635136_SNP | 1635136 | G | A |
| S_9251960 \| \| scaffold14851_1635218_SNP | 1635218 | T | A |
| S_9251962 \| \| scaffold14851_1635258_SNP | 1635258 | T | A |
| S_9251964 \| \| scaffold14851_1635274_SNP | 1635274 | A | G |
| S_9252097 \| \| scaffold14851_1637178_SNP | 1637178 | T | C |
| S_9252099 \| \| scaffold14851_1637196_SNP | 1637196 | T | G |
| S_9252102 \| \| scaffold14851_1637232_SNP | 1637232 | G | C |
| S_9252114 \| \| scaffold14851_1637446_SNP | 1637446 | T | A |
| S_9252163 \| \| scaffold14851_1638000_SNP | 1638000 | A | G |
| S_9252166 \| \| scaffold14851_1638021_SNP | 1638021 | C | T |
| S_9252168 \| \| scaffold14851_1638040_SNP | 1638040 | G | C |
| S_9252201 \| \| scaffold14851_1638579_SNP | 1638579 | T | A |
| S_9252310 \| \| scaffold14851_1639901_SNP | 1639901 | T | G |
| S_9252442 \| \| scaffold14851_1641179_SNP | 1641179 | C | T |
| S_9252466 \| \| scaffold14851_1641686_SNP | 1641686 | A | G |
| S_9252467 \| \| scaffold14851_1641687_SNP | 1641687 | A | T |
| S_9252468 \| \| scaffold14851_1641690_SNP | 1641690 | A | G |
| S_9252471 \| \| scaffold14851_1641724_SNP | 1641724 | A | C |
| S_9252479 \| \| scaffold14851_1641823_SNP | 1641823 | G | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9252483 \| \| scaffold14851_1641871_SNP | 1641871 | T | C |
| S_9252523 \| \| scaffold14851_1642494_SNP | 1642494 | G | T |
| S_9252541 \| \| scaffold14851_1642853_SNP | 1642853 | T | A |
| S_9252551 \| \| scaffold14851_1643163_SNP | 1643163 | A | G |
| S_9252552 \| \| scaffold14851_1643164_SNP | 1643164 | G | A |
| S_9252607 \| \| scaffold14851_1643530_SNP | 1643530 | C | T |
| S_9252630 \| \| scaffold14851_1643599_SNP | 1643599 | G | A |
| S_9252672 \| \| scaffold14851_1643932_SNP | 1643932 | T | G |
| S_9252673 \| \| scaffold14851_1643934_SNP | 1643934 | T | G |
| S_9252674 \| \| scaffold14851_1643935_SNP | 1643935 | G | C |
| S_9252734 \| \| scaffold14851_1644935_SNP | 1644935 | C | T |
| S_9252768 \| \| scaffold14851_1645344_SNP | 1645344 | T | A |
| S_9252795 \| \| scaffold14851_1645850_SNP | 1645850 | C | G |
| S_9252802 \| \| scaffold14851_1646019_SNP | 1646019 | C | T |
| S_9252804 \| \| scaffold14851_1646055_SNP | 1646055 | G | T |
| S_9252820 \| \| scaffold14851_1646379_SNP | 1646379 | T | A |
| S_9252849 \| \| scaffold14851_1646739_SNP | 1646739 | C | T |
| S_9252871 \| \| scaffold14851_1647086_SNP | 1647086 | T | G |
| S_9252872 \| \| scaffold14851_1647087_SNP | 1647087 | G | A |
| S_9252873 \| \| scaffold14851_1647088_SNP | 1647088 | A | T |
| S_9252949 \| \| scaffold14851_1648299_SNP | 1648299 | A | T |
| S_9252973 \| \| scaffold14851_1648641_SNP | 1648641 | A | G |
| S_9253049 \| \| scaffold14851_1649545_SNP | 1649545 | T | C |
| S_9253068 \| \| scaffold14851_1649819_SNP | 1649819 | A | G |
| S_9253081 \| \| scaffold14851_1650088_SNP | 1650088 | T | A |
| S_9253082 \| \| scaffold14851_1650089_SNP | 1650089 | C | A |
| S_9253092 \| \| scaffold14851_1650264_SNP | 1650264 | T | C |
| S_9253097 \| \| scaffold14851_1650335_SNP | 1650335 | A | C |
| S_9253099 \| \| scaffold14851_1650342_SNP | 1650342 | T | A |
| S_9253103 \| \| scaffold14851_1650477_SNP | 1650477 | A | C |
| S_9253105 \| \| scaffold14851_1650544_SNP | 1650544 | A | G |
| S_9253107 \| \| scaffold14851_1650572_SNP | 1650572 | T | C |
| S_9253142 \| \| scaffold14851_1650963_SNP | 1650963 | C | T |
| S_9253188 \| \| scaffold14851_1651783_SNP | 1651783 | T | C |
| S_9253216 \| \| scaffold14851_1652187_SNP | 1652187 | T | C |
| S_9253239 \| \| scaffold14851_1652436_SNP | 1652436 | T | A |
| S_9253240 \| \| scaffold14851_1652444_SNP | 1652444 | G | A |
| S_9253241 \| \| scaffold14851_1652446_SNP | 1652446 | A | G |
| S_9253300 \| \| scaffold14851_1652938_SNP | 1652938 | A | G |
| S_9253379 \| \| scaffold14851_1653892_SNP | 1653892 | A | G |
| S_9253386 \| \| scaffold14851_1653942_SNP | 1653942 | T | G |
| S_9253413 \| \| scaffold14851_1654264_SNP | 1654264 | A | G |
| S_9253445 \| \| scaffold14851_1654663_SNP | 1654663 | T | A |
| S_9253446 \| \| scaffold14851_1654664_SNP | 1654664 | A | C |
| S_9253479 \| \| scaffold14851_1655093_SNP | 1655093 | G | T |
| S_9253494 \| \| scaffold14851_1655335_SNP | 1655335 | A | C |
| S_9253510 \| \| scaffold14851_1655661_SNP | 1655661 | G | A |
| S_9253632 \| \| scaffold14851_1656712_SNP | 1656712 | G | A |
| S_9253638 \| \| scaffold14851_1656834_SNP | 1656834 | G | A |
| S_9253640 \| \| scaffold14851_1656917_SNP | 1656917 | A | C |
| S_9253662 \| \| scaffold14851_1657352_SNP | 1657352 | A | T |
| S_9253663 \| \| scaffold14851_1657353_SNP | 1657353 | A | T |
| S_9253664 \| \| scaffold14851_1657354_SNP | 1657354 | A | T |
| S_9253665 \| \| scaffold14851_1657355_SNP | 1657355 | A | T |
| S_9253698 \| \| scaffold14851_1657826_SNP | 1657826 | G | A |
| S_9253700 \| \| scaffold14851_1657908_SNP | 1657908 | C | A |
| S_9253701 \| \| scaffold14851_1657913_SNP | 1657913 | T | C |
| S_9253706 \| \| scaffold14851_1658094_SNP | 1658094 | G | A |
| S_9253777 \| \| scaffold14851_1658345_SNP | 1658345 | C | T |
| S_9253795 \| \| scaffold14851_1658854_SNP | 1658854 | T | C |
| S_9253796 \| \| scaffold14851_1658868_SNP | 1658868 | T | G |
| S_9253801 \| \| scaffold14851_1658989_SNP | 1658989 | G | A |
| S_9254051 \| \| scaffold14851_1660241_SNP | 1660241 | C | G |
| S_9254058 \| \| scaffold14851_1660368_SNP | 1660368 | A | T |
| S_9254082 \| \| scaffold14851_1660725_SNP | 1660725 | G | T |
| S_9254083 \| \| scaffold14851_1660743_SNP | 1660743 | A | G |
| S_9254086 \| \| scaffold14851_1660839_SNP | 1660839 | A | C |
| S_9254087 \| \| scaffold14851_1660840_SNP | 1660840 | T | A |
| S_9254101 \| \| scaffold14851_1661034_SNP | 1661034 | T | G |
| S_9254105 \| \| scaffold14851_1661105_SNP | 1661105 | C | T |
| S_9254130 \| \| scaffold14851_1661446_SNP | 1661446 | A | C |
| S_9254158 \| \| scaffold14851_1661813_SNP | 1661813 | G | A |
| S_9254252 \| \| scaffold14851_1663311_SNP | 1663311 | C | A |
| S_9254253 \| \| scaffold14851_1663382_SNP | 1663382 | A | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9254254 \| \| scaffold14851_1663414_SNP | 1663414 | A | G |
| S_9254256 \| \| scaffold14851_1663518_SNP | 1663518 | T | G |
| S_9254354 \| \| scaffold14851_1665429_SNP | 1665429 | G | T |
| S_9254358 \| \| scaffold14851_1665524_SNP | 1665524 | C | A |
| S_9254359 \| \| scaffold14851_1665584_SNP | 1665584 | G | A |
| S_9254360 \| \| scaffold14851_1665613_SNP | 1665613 | C | T |
| S_9254439 \| \| scaffold14851_1666983_SNP | 1666983 | C | G |
| S_9254440 \| \| scaffold14851_1666984_SNP | 1666984 | T | G |
| S_9254464 \| \| scaffold14851_1667306_SNP | 1667306 | G | T |
| S_9254475 \| \| scaffold14851_1667642_SNP | 1667642 | C | A |
| scaffold14851_1668181_SNP | 1668181 | A | G |
| S_9254564 \| \| scaffold14851_1668994_SNP | 1668994 | C | T |
| S_9254725 \| \| scaffold14851_1669936_SNP | 1669936 | G | A |
| S_9254794 \| \| scaffold14851_1670218_SNP | 1670218 | T | A |
| S_9254799 \| \| scaffold14851_1670391_SNP | 1670391 | A | G |
| S_9254837 \| \| scaffold14851_1670866_SNP | 1670866 | A | C |
| S_9254939 \| \| scaffold14851_1672327_SNP | 1672327 | T | C |
| S_9254955 \| \| scaffold14851_1672528_SNP | 1672528 | T | C |
| S_9254965 \| \| scaffold14851_1672660_SNP | 1672660 | C | A |
| S_9255039 \| \| scaffold14851_1673468_SNP | 1673468 | T | C |
| S_9255040 \| \| scaffold14851_1673482_SNP | 1673482 | A | G |
| S_9255043 \| \| scaffold14851_1673541_SNP | 1673541 | G | A |
| S_9255044 \| \| scaffold14851_1673552_SNP | 1673552 | G | T |
| S_9255045 \| \| scaffold14851_1673573_SNP | 1673573 | C | T |
| S_9255052 \| \| scaffold14851_1673632_SNP | 1673632 | A | G |
| S_9255056 \| \| scaffold14851_1673671_SNP | 1673671 | C | T |
| S_9255114 \| \| scaffold14851_1674426_SNP | 1674426 | G | A |
| S_9255198 \| \| scaffold14851_1675304_SNP | 1675304 | G | T |
| S_9255234 \| \| scaffold14851_1675635_SNP | 1675635 | T | A |
| S_9255246 \| \| scaffold14851_1675847_SNP | 1675847 | T | C |
| S_9255247 \| \| scaffold14851_1675884_SNP | 1675884 | C | T |
| S_9255248 \| \| scaffold14851_1675903_SNP | 1675903 | A | G |
| S_9255270 \| \| scaffold14851_1676295_SNP | 1676295 | A | G |
| S_9255297 \| \| scaffold14851_1676682_SNP | 1676682 | G | T |
| S_9255303 \| \| scaffold14851_1676753_SNP | 1676753 | T | C |
| S_9255309 \| \| scaffold14851_1676852_SNP | 1676852 | A | G |
| S_9255310 \| \| scaffold14851_1676870_SNP | 1676870 | T | A |
| S_9255321 \| \| scaffold14851_1677077_SNP | 1677077 | A | G |
| S_9255354 \| \| scaffold14851_1677520_SNP | 1677520 | T | C |
| S_9255363 \| \| scaffold14851_1677609_SNP | 1677609 | C | G |
| S_9255393 \| \| scaffold14851_1678108_SNP | 1678108 | C | A |
| S_9255463 \| \| scaffold14851_1679079_SNP | 1679079 | G | A |
| S_9255471 \| \| scaffold14851_1679227_SNP | 1679227 | G | C |
| S_9255496 \| \| scaffold14851_1679631_SNP | 1679631 | A | T |
| S_9255577 \| \| scaffold14851_1680766_SNP | 1680766 | A | G |
| S_9255595 \| \| scaffold14851_1680996_SNP | 1680996 | G | A |
| S_9255634 \| \| scaffold14851_1681553_SNP | 1681553 | T | C |
| S_9255650 \| \| scaffold14851_1681790_SNP | 1681790 | G | A |
| S_9255652 \| \| scaffold14851_1681816_SNP | 1681816 | G | A |
| S_9255731 \| \| scaffold14851_1682908_SNP | 1682908 | T | G |
| S_9255747 \| \| scaffold14851_1683151_SNP | 1683151 | T | C |
| scaffold14851_1684248_SNP | 1684248 | A | G |
| S_9256073 \| \| scaffold14851_1684969_SNP | 1684969 | T | C |
| S_9256631 \| \| scaffold14851_1689187_SNP | 1689187 | T | G |
| S_9256636 \| \| scaffold14851_1689207_SNP | 1689207 | C | T |
| S_9256637 \| \| scaffold14851_1689216_SNP | 1689216 | T | A |
| S_9256638 \| \| scaffold14851_1689217_SNP | 1689217 | G | C |
| S_9256661 \| \| scaffold14851_1689705_SNP | 1689705 | G | A |
| S_9257787 \| \| scaffold14851_1695773_SNP | 1695773 | A | T |
| S_9257790 \| \| scaffold14851_1695811_SNP | 1695811 | T | C |
| S_9257792 \| \| scaffold14851_1695858_SNP | 1695858 | A | G |
| S_9257793 \| \| scaffold14851_1695863_SNP | 1695863 | G | T |
| S_9257800 \| \| scaffold14851_1695974_SNP | 1695974 | G | C |
| S_9257810 \| \| scaffold14851_1696077_SNP | 1696077 | G | C |
| S_9257811 \| \| scaffold14851_1696111_SNP | 1696111 | A | G |
| S_9257852 \| \| scaffold14851_1696367_SNP | 1696367 | A | G |
| S_9257854 \| \| scaffold14851_1696389_SNP | 1696389 | G | A |
| scaffold14851_1697212_SNP | 1697212 | C | T |
| S_9257987 \| \| scaffold14851_1697459_SNP | 1697459 | G | A |
| S_9258024 \| \| scaffold14851_1697846_SNP | 1697846 | G | A |
| S_9258026 \| \| scaffold14851_1697854_SNP | 1697854 | T | C |
| S_9258027 \| \| scaffold14851_1697860_SNP | 1697860 | T | G |
| S_9258332 \| \| scaffold14851_1703418_SNP | 1703418 | G | A |
| S_9258348 \| \| scaffold14851_1703704_SNP | 1703704 | G | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9258352 \| \| scaffold14851_1703718_SNP | 1703718 | T | C |
| scaffold14851_1703742_SNP | 1703742 | A | G |
| S_9258379 \| \| scaffold14851_1703786_SNP | 1703786 | C | T |
| S_9258396 \| \| scaffold14851_1703928_SNP | 1703928 | G | T |
| S_9258397 \| \| scaffold14851_1703929_SNP | 1703929 | T | A |
| S_9258411 \| \| scaffold14851_1704124_SNP | 1704124 | T | C |
| S_9258419 \| \| scaffold14851_1704278_SNP | 1704278 | G | A |
| S_9258438 \| \| scaffold14851_1704499_SNP | 1704499 | G | A |
| S_9258439 \| \| scaffold14851_1704540_SNP | 1704540 | T | C |
| S_9258449 \| \| scaffold14851_1704822_SNP | 1704822 | G | A |
| S_9258504 \| \| scaffold14851_1705704_SNP | 1705704 | T | A |
| S_9258508 \| \| scaffold14851_1705773_SNP | 1705773 | T | G |
| S_9258521 \| \| scaffold14851_1706004_SNP | 1706004 | T | G |
| S_9258525 \| \| scaffold14851_1706066_SNP | 1706066 | T | G |
| S_9258526 \| \| scaffold14851_1706093_SNP | 1706093 | G | T |
| S_9258529 \| \| scaffold14851_1706167_SNP | 1706167 | T | A |
| S_9258530 \| \| scaffold14851_1706168_SNP | 1706168 | A | T |
| S_9258539 \| \| scaffold14851_1706319_SNP | 1706319 | C | T |
| S_9258576 \| \| scaffold14851_1706786_SNP | 1706786 | T | A |
| S_9258588 \| \| scaffold14851_1706999_SNP | 1706999 | C | G |
| S_9258596 \| \| scaffold14851_1707152_SNP | 1707152 | T | G |
| S_9258610 \| \| scaffold14851_1707387_SNP | 1707387 | A | T |
| S_9258620 \| \| scaffold14851_1707616_SNP | 1707616 | C | T |
| S_9258716 \| \| scaffold14851_1709316_SNP | 1709316 | C | T |
| S_9258719 \| \| scaffold14851_1709326_SNP | 1709326 | C | T |
| S_9258720 \| \| scaffold14851_1709332_SNP | 1709332 | A | C |
| S_9258732 \| \| scaffold14851_1709500_SNP | 1709500 | G | A |
| S_9258746 \| \| scaffold14851_1709797_SNP | 1709797 | G | A |
| S_9258774 \| \| scaffold14851_1710179_SNP | 1710179 | A | C |
| S_9258807 \| \| scaffold14851_1710342_SNP | 1710342 | C | G |
| S_9258824 \| \| scaffold14851_1710360_SNP | 1710360 | G | T |
| S_9258856 \| \| scaffold14851_1710463_SNP | 1710463 | G | A |
| S_9258901 \| \| scaffold14851_1710795_SNP | 1710795 | A | C |
| S_9258902 \| \| scaffold14851_1710801_SNP | 1710801 | C | G |
| S_9258925 \| \| scaffold14851_1711183_SNP | 1711183 | C | T |
| S_9258974 \| \| scaffold14851_1711854_SNP | 1711854 | C | G |
| S_9258981 \| \| scaffold14851_1711927_SNP | 1711927 | T | G |
| S_9258993 \| \| scaffold14851_1712091_SNP | 1712091 | C | T |
| S_9259002 \| \| scaffold14851_1712126_SNP | 1712126 | C | T |
| S_9259003 \| \| scaffold14851_1712128_SNP | 1712128 | T | G |
| S_9259013 \| \| scaffold14851_1712328_SNP | 1712328 | T | A |
| S_9259020 \| \| scaffold14851_1712455_SNP | 1712455 | T | G |
| S_9259029 \| \| scaffold14851_1712613_SNP | 1712613 | G | C |
| S_9259030 \| \| scaffold14851_1712616_SNP | 1712616 | G | A |
| S_9259031 \| \| scaffold14851_1712634_SNP | 1712634 | C | G |
| S_9259034 \| \| scaffold14851_1712676_SNP | 1712676 | A | G |
| S_9259226 \| \| scaffold14851_1716026_SNP | 1716026 | C | T |
| scaffold14851_1716095_SNP | 1716095 | A | G |
| S_9259237 \| \| scaffold14851_1716125_SNP | 1716125 | C | A |
| S_9259239 \| \| scaffold14851_1716192_SNP | 1716192 | A | C |
| S_9259240 \| \| scaffold14851_1716209_SNP | 1716209 | G | A |
| S_9259641 \| \| scaffold14851_1717922_SNP | 1717922 | C | T |
| S_9259747 \| \| scaffold14851_1718916_SNP | 1718916 | C | A |
| S_9259766 \| \| scaffold14851_1719319_SNP | 1719319 | T | G |
| S_9259816 \| \| scaffold14851_1720163_SNP | 1720163 | A | G |
| S_9259817 \| \| scaffold14851_1720165_SNP | 1720165 | G | A |
| S_9259821 \| \| scaffold14851_1720216_SNP | 1720216 | T | A |
| S_9259822 \| \| scaffold14851_1720223_SNP | 1720223 | A | T |
| S_9259823 \| \| scaffold14851_1720270_SNP | 1720270 | T | A |
| S_9259867 \| \| scaffold14851_1720349_SNP | 1720349 | G | A |
| S_9259868 \| \| scaffold14851_1720357_SNP | 1720357 | A | T |
| S_9259884 \| \| scaffold14851_1720546_SNP | 1720546 | G | A |
| S_9259893 \| \| scaffold14851_1720581_SNP | 1720581 | T | C |
| S_9259894 \| \| scaffold14851_1720603_SNP | 1720603 | T | C |
| S_9260025 \| \| scaffold14851_1722173_SNP | 1722173 | T | C |
| S_9260054 \| \| scaffold14851_1722432_SNP | 1722432 | C | T |
| S_9260068 \| \| scaffold14851_1722647_SNP | 1722647 | G | A |
| S_9260100 \| \| scaffold14851_1723182_SNP | 1723182 | G | A |
| S_9260171 \| \| scaffold14851_1724077_SNP | 1724077 | G | A |
| S_9260172 \| \| scaffold14851_1724102_SNP | 1724102 | A | T |
| S_9260180 \| \| scaffold14851_1724292_SNP | 1724292 | T | G |
| S_9260206 \| \| scaffold14851_1724645_SNP | 1724645 | C | T |
| S_9260254 \| \| scaffold14851_1725491_SNP | 1725491 | G | T |
| S_9260278 \| \| scaffold14851_1725734_SNP | 1725734 | A | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9260329 \| \| scaffold14851_1728455_SNP | 1728455 | A | G |
| S_9260362 \| \| scaffold14851_1728875_SNP | 1728875 | A | T |
| S_9260452 \| \| scaffold14851_1731054_SNP | 1731054 | T | G |
| S_9260562 \| \| scaffold14851_1732497_SNP | 1732497 | A | G |
| S_9260580 \| \| scaffold14851_1732691_SNP | 1732691 | T | A |
| S_9260582 \| \| scaffold14851_1732717_SNP | 1732717 | A | G |
| S_9260702 \| \| scaffold14851_1733721_SNP | 1733721 | T | C |
| S_9260712 \| \| scaffold14851_1733765_SNP | 1733765 | A | T |
| S_9260751 \| \| scaffold14851_1734095_SNP | 1734095 | T | A |
| S_9260807 \| \| scaffold14851_1734466_SNP | 1734466 | C | A |
| S_9260841 \| \| scaffold14851_1734822_SNP | 1734822 | G | T |
| S_9260842 \| \| scaffold14851_1734837_SNP | 1734837 | A | C |
| S_9260854 \| \| scaffold14851_1734953_SNP | 1734953 | A | G |
| S_9260856 \| \| scaffold14851_1734980_SNP | 1734980 | C | T |
| scaffold14851_1736002_SNP | 1736002 | A | G |
| S_9261169 \| \| scaffold14851_1738526_SNP | 1738526 | T | C |
| scaffold14851_1740383_SNP | 1740383 | G | A |
| S_9261972 \| \| scaffold14851_1754305_SNP | 1754305 | C | G |
| S_9261998 \| \| scaffold14851_1754671_SNP | 1754671 | C | A |
| S_9262970 \| \| scaffold14851_1766482_SNP | 1766482 | C | T |
| S_9262973 \| \| scaffold14851_1766496_SNP | 1766496 | A | C |
| S_9262974 \| \| scaffold14851_1766582_SNP | 1766582 | G | T |
| S_9262975 \| \| scaffold14851_1766597_SNP | 1766597 | T | A |
| S_9262983 \| \| scaffold14851_1766761_SNP | 1766761 | G | T |
| scaffold14851_1772496_SNP | 1772496 | C | A |
| S_9263864 \| \| scaffold14851_1776015_SNP | 1776015 | T | C |
| S_9263940 \| \| scaffold14851_1776324_SNP | 1776324 | T | C |
| S_9263942 \| \| scaffold14851_1776336_SNP | 1776336 | G | A |
| S_9264655 \| \| scaffold14851_1785873_SNP | 1785873 | G | A |
| S_9264659 \| \| scaffold14851_1785894_SNP | 1785894 | C | T |
| S_9266134 \| \| scaffold14851_1793879_SNP | 1793879 | G | A |
| S_9266758 \| \| scaffold14851_1804064_SNP | 1804064 | T | C |
| S_9267122 \| \| scaffold14851_1807971_SNP | 1807971 | G | T |
| S_9267123 \| \| scaffold14851_1807975_SNP | 1807975 | A | G |
| S_9267439 \| \| scaffold14851_1818198_SNP | 1818198 | G | A |
| S_9267440 \| \| scaffold14851_1818199_SNP | 1818199 | A | C |
| S_9268028 \| \| scaffold14851_1819554_SNP | 1819554 | T | C |
| S_9268051 \| \| scaffold14851_1819646_SNP | 1819646 | A | G |
| S_9270880 \| \| scaffold14851_1825354_SNP | 1825354 | G | C |
| scaffold14851_1826898_SNP | 1826898 | G | C |
| S_9271010 \| \| scaffold14851_1826951_SNP | 1826951 | A | G |
| S_9271091 \| \| scaffold14851_1827651_SNP | 1827651 | A | C |
| S_9271092 \| \| scaffold14851_1827661_SNP | 1827661 | A | T |
| scaffold14851_1833052_SNP | 1833052 | C | A |
| scaffold14851_1835539_SNP | 1835539 | T | A |
| S_9272079 \| \| scaffold14851_1842680_SNP | 1842680 | T | C |
| S_9272080 \| \| scaffold14851_1842683_SNP | 1842683 | T | A |
| S_9272081 \| \| scaffold14851_1842727_SNP | 1842727 | C | G |
| S_9272300 \| \| scaffold14851_1844397_SNP | 1844397 | T | A |
| S_9272904 \| \| scaffold14851_1852534_SNP | 1852534 | C | T |
| S_9272908 \| \| scaffold14851_1852617_SNP | 1852617 | A | G |
| S_9274550 \| \| scaffold14851_1868867_SNP | 1868867 | G | A |
| scaffold14851_1876904_SNP | 1876904 | G | T |
| S_9276112 \| \| scaffold14851_1876951_SNP | 1876951 | C | T |
| S_9276113 \| \| scaffold14851_1876960_SNP | 1876960 | T | C |
| S_9276115 \| \| scaffold14851_1876977_SNP | 1876977 | A | G |
| scaffold14851_1881812_SNP | 1881812 | C | G |
| scaffold14851_1881814_SNP | 1881814 | T | A |
| S_9276876 \| \| scaffold14851_1882129_SNP | 1882129 | G | A |
| S_9276897 \| \| scaffold14851_1882477_SNP | 1882477 | C | T |
| scaffold14851_1895610_SNP | 1895610 | G | A |
| scaffold14851_1895625_SNP | 1895625 | T | C |
| scaffold14851_1895640_SNP | 1895640 | C | T |
| scaffold14851_1896426_SNP | 1896426 | G | A |
| S_9277550 \| \| scaffold14851_1896501_SNP | 1896501 | G | A |
| scaffold14851_1896810_SNP | 1896810 | C | T |
| scaffold14851_1896837_SNP | 1896837 | C | T |
| scaffold14851_1896852_SNP | 1896852 | T | C |
| S_9277992 \| \| scaffold14851_1908339_SNP | 1908339 | A | T |
| S_9278022 \| \| scaffold14851_1909107_SNP | 1909107 | A | G |
| S_9278276 \| \| scaffold14851_1912006_SNP | 1912006 | A | G |
| S_9278278 \| \| scaffold14851_1912056_SNP | 1912056 | A | T |
| S_9278333 \| \| scaffold14851_1912512_SNP | 1912512 | G | A |
| S_9278803 \| \| scaffold14851_1921165_SNP | 1921165 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9278820 \| \| scaffold14851_1921424_SNP | 1921424 | C | T |
| S_9278823 \| \| scaffold14851_1921449_SNP | 1921449 | A | T |
| S_9278825 \| \| scaffold14851_1921476_SNP | 1921476 | C | T |
| S_9278827 \| \| scaffold14851_1921478_SNP | 1921478 | T | C |
| scaffold14851_1986576_SNP | 1986576 | A | C |
| S_9290163 \| \| scaffold14851_2038378_SNP | 2038378 | C | G |
| S_9290440 \| \| scaffold14851_2041386_SNP | 2041386 | T | G |
| S_9291805 \| \| scaffold14851_2053134_SNP | 2053134 | T | C |
| S_9291830 \| \| scaffold14851_2053459_SNP | 2053459 | A | T |
| S_9291833 \| \| scaffold14851_2053505_SNP | 2053505 | G | C |
| scaffold14851_2056437_SNP | 2056437 | A | C |
| S_9292436 \| \| scaffold14851_2066380_SNP | 2066380 | C | T |
| scaffold14851_2077720_SNP | 2077720 | G | C |
| S_9294188 \| \| scaffold14851_2082270_SNP | 2082270 | T | G |
| scaffold14851_2084769_SNP | 2084769 | A | G |
| S_9294564 \| \| scaffold14851_2086113_SNP | 2086113 | G | T |
| S_9294778 \| \| scaffold14851_2088811_SNP | 2088811 | C | A |
| S_9294846 \| \| scaffold14851_2089752_SNP | 2089752 | C | T |
| S_9294877 \| \| scaffold14851_2090179_SNP | 2090179 | C | T |
| S_9294887 \| \| scaffold14851_2090460_SNP | 2090460 | G | A |
| S_9295484 \| \| scaffold14851_2098022_SNP | 2098022 | C | G |
| S_9295567 \| \| scaffold14851_2098976_SNP | 2098976 | A | G |
| S_9296181 \| \| scaffold14851_2107264_SNP | 2107264 | C | G |
| S_9296195 \| \| scaffold14851_2107482_SNP | 2107482 | G | A |
| S_9296295 \| \| scaffold14851_2108717_SNP | 2108717 | A | T |
| S_9296301 \| \| scaffold14851_2108883_SNP | 2108883 | G | A |
| S_9296306 \| \| scaffold14851_2108959_SNP | 2108959 | G | T |
| S_9296334 \| \| scaffold14851_2109382_SNP | 2109382 | C | G |
| S_9296351 \| \| scaffold14851_2109648_SNP | 2109648 | T | A |
| S_9296352 \| \| scaffold14851_2109649_SNP | 2109649 | A | C |
| S_9296409 \| \| scaffold14851_2110091_SNP | 2110091 | G | T |
| S_9296415 \| \| scaffold14851_2110167_SNP | 2110167 | A | G |
| S_9296489 \| \| scaffold14851_2110822_SNP | 2110822 | T | A |
| S_9296508 \| \| scaffold14851_2111315_SNP | 2111315 | T | A |
| S_9296575 \| \| scaffold14851_2112384_SNP | 2112384 | T | A |
| S_9296649 \| \| scaffold14851_2113337_SNP | 2113337 | T | C |
| S_9296711 \| \| scaffold14851_2114130_SNP | 2114130 | A | T |
| S_9296877 \| \| scaffold14851_2115877_SNP | 2115877 | C | T |
| S_9297012 \| \| scaffold14851_2118750_SNP | 2118750 | A | T |
| S_9297061 \| \| scaffold14851_2118945_SNP | 2118945 | G | A |
| S_9297083 \| \| scaffold14851_2118973_SNP | 2118973 | A | G |
| S_9297096 \| \| scaffold14851_2119035_SNP | 2119035 | G | A |
| S_9297177 \| \| scaffold14851_2120237_SNP | 2120237 | G | T |
| S_9297222 \| \| scaffold14851_2120708_SNP | 2120708 | G | A |
| S_9297285 \| \| scaffold14851_2121257_SNP | 2121257 | A | T |
| S_9297439 \| \| scaffold14851_2122997_SNP | 2122997 | C | A |
| S_9297452 \| \| scaffold14851_2123274_SNP | 2123274 | A | G |
| S_9297455 \| \| scaffold14851_2123300_SNP | 2123300 | A | G |
| S_9297502 \| \| scaffold14851_2123906_SNP | 2123906 | A | G |
| S_9297530 \| \| scaffold14851_2124275_SNP | 2124275 | G | A |
| S_9297536 \| \| scaffold14851_2124334_SNP | 2124334 | T | G |
| S_9297612 \| \| scaffold14851_2125595_SNP | 2125595 | T | A |
| S_9297750 \| \| scaffold14851_2127037_SNP | 2127037 | G | A |
| S_9297828 \| \| scaffold14851_2127824_SNP | 2127824 | T | A |
| S_9297890 \| \| scaffold14851_2128723_SNP | 2128723 | C | A |
| S_9297893 \| \| scaffold14851_2128740_SNP | 2128740 | A | T |
| S_9299027 \| \| scaffold14851_2144751_SNP | 2144751 | T | C |
| S_9299042 \| \| scaffold14851_2144959_SNP | 2144959 | C | A |
| S_9299061 \| \| scaffold14851_2145097_SNP | 2145097 | C | G |
| S_9299064 \| \| scaffold14851_2145113_SNP | 2145113 | T | A |
| S_9299098 \| \| scaffold14851_2145415_SNP | 2145415 | T | G |
| S_9299110 \| \| scaffold14851_2145555_SNP | 2145555 | T | C |
| S_9299119 \| \| scaffold14851_2145654_SNP | 2145654 | C | T |
| S_9299159 \| \| scaffold14851_2145941_SNP | 2145941 | G | T |
| S_9299166 \| \| scaffold14851_2146007_SNP | 2146007 | C | T |
| S_9299180 \| \| scaffold14851_2146100_SNP | 2146100 | A | T |
| S_9299213 \| \| scaffold14851_2146417_SNP | 2146417 | T | A |
| S_9299215 \| \| scaffold14851_2146436_SNP | 2146436 | C | T |
| S_9299235 \| \| scaffold14851_2146591_SNP | 2146591 | C | T |
| S_9299239 \| \| scaffold14851_2146633_SNP | 2146633 | G | A |
| S_9299280 \| \| scaffold14851_2147405_SNP | 2147405 | G | T |
| S_9299347 \| \| scaffold14851_2147968_SNP | 2147968 | T | G |
| S_9299452 \| \| scaffold14851_2150039_SNP | 2150039 | A | G |
| S_9299455 \| \| scaffold14851_2150077_SNP | 2150077 | A | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|------|------|------|------|
| S_9299643 \| \| scaffold14851_2152028_SNP | 2152028 | C | T |
| S_9299716 \| \| scaffold14851_2152766_SNP | 2152766 | A | G |
| S_9299951 \| \| scaffold14851_2155425_SNP | 2155425 | T | G |
| S_9300063 \| \| scaffold14851_2157600_SNP | 2157600 | C | A |
| S_9300092 \| \| scaffold14851_2157976_SNP | 2157976 | C | T |
| S_9300107 \| \| scaffold14851_2158080_SNP | 2158080 | A | G |
| S_9300116 \| \| scaffold14851_2158212_SNP | 2158212 | T | C |
| S_9300120 \| \| scaffold14851_2158240_SNP | 2158240 | G | T |
| S_9300157 \| \| scaffold14851_2158706_SNP | 2158706 | C | T |
| S_9300158 \| \| scaffold14851_2158716_SNP | 2158716 | G | A |
| S_9300292 \| \| scaffold14851_2160548_SNP | 2160548 | T | C |
| S_9300314 \| \| scaffold14851_2161052_SNP | 2161052 | T | A |
| S_9300430 \| \| scaffold14851_2162914_SNP | 2162914 | G | T |
| S_9300462 \| \| scaffold14851_2163342_SNP | 2163342 | A | T |
| S_9300463 \| \| scaffold14851_2163346_SNP | 2163346 | A | G |
| S_9300674 \| \| scaffold14851_2166722_SNP | 2166722 | T | G |
| S_9300813 \| \| scaffold14851_2168856_SNP | 2168856 | G | T |
| S_9301186 \| \| scaffold14851_2174869_SNP | 2174869 | C | T |
| S_9301512 \| \| scaffold14851_2179528_SNP | 2179528 | C | T |
| S_9301568 \| \| scaffold14851_2180811_SNP | 2180811 | T | G |
| S_9301614 \| \| scaffold14851_2181689_SNP | 2181689 | G | A |
| S_9301750 \| \| scaffold14851_2183786_SNP | 2183786 | T | G |
| S_9301904 \| \| scaffold14851_2185186_SNP | 2185186 | T | G |
| S_9302305 \| \| scaffold14851_2189058_SNP | 2189058 | T | C |
| S_9302438 \| \| scaffold14851_2191052_SNP | 2191052 | T | G |
| S_9302476 \| \| scaffold14851_2191624_SNP | 2191624 | T | A |
| S_9302591 \| \| scaffold14851_2193113_SNP | 2193113 | A | G |
| S_9302790 \| \| scaffold14851_2195521_SNP | 2195521 | C | T |
| S_9302793 \| \| scaffold14851_2195577_SNP | 2195577 | C | T |
| S_9302798 \| \| scaffold14851_2195646_SNP | 2195646 | G | T |
| S_9302881 \| \| scaffold14851_2196960_SNP | 2196960 | G | A |
| S_9302882 \| \| scaffold14851_2196961_SNP | 2196961 | C | T |
| S_9302935 \| \| scaffold14851_2197636_SNP | 2197636 | C | T |
| S_9302960 \| \| scaffold14851_2197864_SNP | 2197864 | G | C |
| S_9302990 \| \| scaffold14851_2198179_SNP | 2198179 | T | G |
| S_9303097 \| \| scaffold14851_2199762_SNP | 2199762 | A | C |
| S_9303289 \| \| scaffold14851_2202804_SNP | 2202804 | A | T |
| S_9303293 \| \| scaffold14851_2202895_SNP | 2202895 | C | T |
| S_9303348 \| \| scaffold14851_2203980_SNP | 2203980 | T | C |
| S_9303354 \| \| scaffold14851_2204042_SNP | 2204042 | T | G |
| S_9303596 \| \| scaffold14851_2205712_SNP | 2205712 | A | G |
| S_9303651 \| \| scaffold14851_2206350_SNP | 2206350 | A | G |
| S_9304195 \| \| scaffold14851_2214640_SNP | 2214640 | G | A |
| S_9304211 \| \| scaffold14851_2214952_SNP | 2214952 | C | A |
| S_9304804 \| \| scaffold14851_2222811_SNP | 2222811 | C | T |
| S_9305584 \| \| scaffold14851_2232931_SNP | 2232931 | C | G |
| S_9305632 \| \| scaffold14851_2233518_SNP | 2233518 | A | T |
| S_9305677 \| \| scaffold14851_2234447_SNP | 2234447 | G | A |
| S_9305808 \| \| scaffold14851_2236162_SNP | 2236162 | G | C |
| S_9305869 \| \| scaffold14851_2237449_SNP | 2237449 | T | G |
| S_9305923 \| \| scaffold14851_2238077_SNP | 2238077 | A | G |
| S_9306165 \| \| scaffold14851_2241148_SNP | 2241148 | G | A |
| S_9306167 \| \| scaffold14851_2241216_SNP | 2241216 | T | C |
| S_9306179 \| \| scaffold14851_2241503_SNP | 2241503 | A | G |
| S_9306185 \| \| scaffold14851_2241524_SNP | 2241524 | G | A |
| S_9306266 \| \| scaffold14851_2242345_SNP | 2242345 | G | A |
| S_9306333 \| \| scaffold14851_2243328_SNP | 2243328 | G | C |
| S_9306398 \| \| scaffold14851_2244225_SNP | 2244225 | T | C |
| S_9306448 \| \| scaffold14851_2244811_SNP | 2244811 | T | C |
| S_9306471 \| \| scaffold14851_2245069_SNP | 2245069 | C | T |
| S_9306547 \| \| scaffold14851_2246314_SNP | 2246314 | C | T |
| S_9306595 \| \| scaffold14851_2246921_SNP | 2246921 | C | A |
| S_9306625 \| \| scaffold14851_2247412_SNP | 2247412 | G | A |
| S_9306634 \| \| scaffold14851_2247609_SNP | 2247609 | G | A |
| S_9306697 \| \| scaffold14851_2248527_SNP | 2248527 | C | T |
| S_9306708 \| \| scaffold14851_2248596_SNP | 2248596 | C | T |
| S_9306736 \| \| scaffold14851_2248958_SNP | 2248958 | G | A |
| S_9306775 \| \| scaffold14851_2249568_SNP | 2249568 | A | G |
| S_9306797 \| \| scaffold14851_2249844_SNP | 2249844 | G | C |
| S_9306848 \| \| scaffold14851_2250715_SNP | 2250715 | G | T |
| S_9306866 \| \| scaffold14851_2250909_SNP | 2250909 | C | G |
| S_9306913 \| \| scaffold14851_2251531_SNP | 2251531 | G | T |
| S_9306976 \| \| scaffold14851_2252295_SNP | 2252295 | C | G |
| S_9306979 \| \| scaffold14851_2252349_SNP | 2252349 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9306983 \|\| scaffold14851_2252397_SNP | 2252397 | A | G |
| S_9307003 \|\| scaffold14851_2252625_SNP | 2252625 | C | A |
| S_9307008 \|\| scaffold14851_2252667_SNP | 2252667 | G | C |
| S_9307022 \|\| scaffold14851_2252985_SNP | 2252985 | A | T |
| S_9307064 \|\| scaffold14851_2253729_SNP | 2253729 | C | T |
| S_9307145 \|\| scaffold14851_2254726_SNP | 2254726 | C | G |
| S_9307159 \|\| scaffold14851_2254952_SNP | 2254952 | G | C |
| S_9307243 \|\| scaffold14851_2255336_SNP | 2255336 | T | C |
| S_9307244 \|\| scaffold14851_2255342_SNP | 2255342 | A | T |
| S_9307289 \|\| scaffold14851_2256026_SNP | 2256026 | C | T |
| S_9307309 \|\| scaffold14851_2256329_SNP | 2256329 | G | A |
| S_9307315 \|\| scaffold14851_2256447_SNP | 2256447 | T | C |
| S_9307318 \|\| scaffold14851_2256468_SNP | 2256468 | G | C |
| S_9307334 \|\| scaffold14851_2256795_SNP | 2256795 | A | T |
| S_9307394 \|\| scaffold14851_2257607_SNP | 2257607 | G | A |
| S_9307488 \|\| scaffold14851_2258552_SNP | 2258552 | G | A |
| S_9307597 \|\| scaffold14851_2260546_SNP | 2260546 | G | T |
| S_9307650 \|\| scaffold14851_2261250_SNP | 2261250 | C | G |
| S_9307655 \|\| scaffold14851_2261357_SNP | 2261357 | T | A |
| S_9307658 \|\| scaffold14851_2261371_SNP | 2261371 | C | T |
| S_9307659 \|\| scaffold14851_2261373_SNP | 2261373 | G | C |
| S_9307727 \|\| scaffold14851_2261913_SNP | 2261913 | G | A |
| S_9307729 \|\| scaffold14851_2261923_SNP | 2261923 | A | G |
| S_9307730 \|\| scaffold14851_2261929_SNP | 2261929 | G | T |
| S_9307753 \|\| scaffold14851_2262222_SNP | 2262222 | G | A |
| S_9307757 \|\| scaffold14851_2262255_SNP | 2262255 | A | C |
| S_9307840 \|\| scaffold14851_2262709_SNP | 2262709 | A | G |
| S_9307896 \|\| scaffold14851_2263028_SNP | 2263028 | G | C |
| S_9307897 \|\| scaffold14851_2263037_SNP | 2263037 | A | G |
| S_9307932 \|\| scaffold14851_2263339_SNP | 2263339 | G | T |
| S_9307960 \|\| scaffold14851_2263640_SNP | 2263640 | C | A |
| S_9307972 \|\| scaffold14851_2263868_SNP | 2263868 | A | T |
| S_9307986 \|\| scaffold14851_2263992_SNP | 2263992 | A | T |
| S_9307999 \|\| scaffold14851_2264165_SNP | 2264165 | A | G |
| S_9308027 \|\| scaffold14851_2264251_SNP | 2264251 | T | G |
| S_9308030 \|\| scaffold14851_2264319_SNP | 2264319 | T | A |
| S_9308033 \|\| scaffold14851_2264352_SNP | 2264352 | T | A |
| S_9308034 \|\| scaffold14851_2264378_SNP | 2264378 | A | T |
| S_9308061 \|\| scaffold14851_2264832_SNP | 2264832 | A | T |
| S_9308063 \|\| scaffold14851_2264892_SNP | 2264892 | A | C |
| S_9308064 \|\| scaffold14851_2264930_SNP | 2264930 | A | C |
| S_9308065 \|\| scaffold14851_2264961_SNP | 2264961 | T | A |
| S_9308103 \|\| scaffold14851_2265482_SNP | 2265482 | T | C |
| S_9308105 \|\| scaffold14851_2265496_SNP | 2265496 | T | C |
| S_9308110 \|\| scaffold14851_2265594_SNP | 2265594 | C | A |
| S_9308117 \|\| scaffold14851_2265770_SNP | 2265770 | A | G |
| S_9308120 \|\| scaffold14851_2265807_SNP | 2265807 | T | G |
| S_9308160 \|\| scaffold14851_2266205_SNP | 2266205 | A | G |
| S_9308161 \|\| scaffold14851_2266207_SNP | 2266207 | T | C |
| S_9308162 \|\| scaffold14851_2266226_SNP | 2266226 | C | T |
| S_9308177 \|\| scaffold14851_2266477_SNP | 2266477 | T | A |
| S_9308178 \|\| scaffold14851_2266479_SNP | 2266479 | T | A |
| S_9308301 \|\| scaffold14851_2268103_SNP | 2268103 | C | A |
| S_9308304 \|\| scaffold14851_2268239_SNP | 2268239 | A | G |
| S_9308307 \|\| scaffold14851_2268256_SNP | 2268256 | A | C |
| S_9308308 \|\| scaffold14851_2268275_SNP | 2268275 | A | T |
| S_9308309 \|\| scaffold14851_2268277_SNP | 2268277 | T | C |
| S_9308314 \|\| scaffold14851_2268326_SNP | 2268326 | A | T |
| S_9308316 \|\| scaffold14851_2268353_SNP | 2268353 | T | C |
| S_9308322 \|\| scaffold14851_2268479_SNP | 2268479 | G | C |
| S_9308341 \|\| scaffold14851_2268863_SNP | 2268863 | T | G |
| S_9308355 \|\| scaffold14851_2269103_SNP | 2269103 | T | A |
| S_9308371 \|\| scaffold14851_2269228_SNP | 2269228 | G | A |
| S_9308398 \|\| scaffold14851_2269555_SNP | 2269555 | C | T |
| S_9308400 \|\| scaffold14851_2269575_SNP | 2269575 | G | T |
| S_9308428 \|\| scaffold14851_2270023_SNP | 2270023 | G | A |
| S_9308442 \|\| scaffold14851_2270186_SNP | 2270186 | C | T |
| S_9308443 \|\| scaffold14851_2270253_SNP | 2270253 | A | C |
| S_9308456 \|\| scaffold14851_2270388_SNP | 2270388 | A | G |
| S_9308457 \|\| scaffold14851_2270410_SNP | 2270410 | A | T |
| S_9308461 \|\| scaffold14851_2270506_SNP | 2270506 | A | T |
| S_9308486 \|\| scaffold14851_2270747_SNP | 2270747 | G | A |
| S_9308506 \|\| scaffold14851_2270891_SNP | 2270891 | T | C |
| S_9308508 \|\| scaffold14851_2270920_SNP | 2270920 | T | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9308514 \| \| scaffold14851_2271088_SNP | 2271088 | C | T |
| S_9308517 \| \| scaffold14851_2271150_SNP | 2271150 | A | G |
| S_9308518 \| \| scaffold14851_2271167_SNP | 2271167 | C | A |
| S_9308521 \| \| scaffold14851_2271185_SNP | 2271185 | C | G |
| S_9308541 \| \| scaffold14851_2271534_SNP | 2271534 | T | C |
| S_9308557 \| \| scaffold14851_2271723_SNP | 2271723 | A | G |
| S_9308622 \| \| scaffold14851_2272863_SNP | 2272863 | T | C |
| S_9308677 \| \| scaffold14851_2273774_SNP | 2273774 | T | C |
| S_9308709 \| \| scaffold14851_2274579_SNP | 2274579 | G | A |
| S_9308717 \| \| scaffold14851_2274799_SNP | 2274799 | G | A |
| S_9308723 \| \| scaffold14851_2274853_SNP | 2274853 | G | A |
| S_9308724 \| \| scaffold14851_2274875_SNP | 2274875 | T | C |
| S_9308735 \| \| scaffold14851_2275042_SNP | 2275042 | G | A |
| S_9308795 \| \| scaffold14851_2276044_SNP | 2276044 | G | A |
| S_9308799 \| \| scaffold14851_2276090_SNP | 2276090 | G | A |
| S_9308840 \| \| scaffold14851_2276940_SNP | 2276940 | C | A |
| S_9308843 \| \| scaffold14851_2276972_SNP | 2276972 | T | C |
| S_9308851 \| \| scaffold14851_2277102_SNP | 2277102 | T | G |
| S_9308855 \| \| scaffold14851_2277153_SNP | 2277153 | A | G |
| S_9308871 \| \| scaffold14851_2277337_SNP | 2277337 | G | T |
| S_9308895 \| \| scaffold14851_2277679_SNP | 2277679 | T | A |
| S_9308903 \| \| scaffold14851_2277809_SNP | 2277809 | T | C |
| S_9308928 \| \| scaffold14851_2278104_SNP | 2278104 | C | G |
| S_9308930 \| \| scaffold14851_2278183_SNP | 2278183 | G | A |
| S_9308955 \| \| scaffold14851_2278758_SNP | 2278758 | T | G |
| S_9309027 \| \| scaffold14851_2279469_SNP | 2279469 | C | T |
| S_9309030 \| \| scaffold14851_2279530_SNP | 2279530 | G | A |
| S_9309032 \| \| scaffold14851_2279543_SNP | 2279543 | A | C |
| S_9309441 \| \| scaffold14851_2283514_SNP | 2283514 | T | A |
| S_9309510 \| \| scaffold14851_2284564_SNP | 2284564 | T | C |
| S_9309640 \| \| scaffold14851_2286278_SNP | 2286278 | A | G |
| S_9309667 \| \| scaffold14851_2286530_SNP | 2286530 | C | T |
| S_9309692 \| \| scaffold14851_2286852_SNP | 2286852 | C | T |
| S_9309754 \| \| scaffold14851_2287853_SNP | 2287853 | T | G |
| S_9309841 \| \| scaffold14851_2288997_SNP | 2288997 | T | A |
| S_9309858 \| \| scaffold14851_2289422_SNP | 2289422 | T | C |
| S_9309888 \| \| scaffold14851_2290039_SNP | 2290039 | G | A |
| S_9309926 \| \| scaffold14851_2290488_SNP | 2290488 | A | T |
| S_9309982 \| \| scaffold14851_2291244_SNP | 2291244 | T | G |
| S_9310033 \| \| scaffold14851_2291801_SNP | 2291801 | T | C |
| S_9310065 \| \| scaffold14851_2292160_SNP | 2292160 | T | G |
| S_9310070 \| \| scaffold14851_2292254_SNP | 2292254 | T | A |
| S_9310088 \| \| scaffold14851_2292561_SNP | 2292561 | C | T |
| S_9310129 \| \| scaffold14851_2293132_SNP | 2293132 | G | A |
| S_9310162 \| \| scaffold14851_2293581_SNP | 2293581 | G | A |
| S_9310173 \| \| scaffold14851_2293796_SNP | 2293796 | A | T |
| S_9310174 \| \| scaffold14851_2293809_SNP | 2293809 | G | T |
| S_9310216 \| \| scaffold14851_2294678_SNP | 2294678 | A | G |
| S_9310218 \| \| scaffold14851_2294688_SNP | 2294688 | A | C |
| S_9310229 \| \| scaffold14851_2294838_SNP | 2294838 | T | C |
| S_9310280 \| \| scaffold14851_2295164_SNP | 2295164 | C | T |
| S_9310346 \| \| scaffold14851_2295705_SNP | 2295705 | T | C |
| S_9310348 \| \| scaffold14851_2295707_SNP | 2295707 | C | T |
| S_9310423 \| \| scaffold14851_2296463_SNP | 2296463 | G | A |
| S_9310533 \| \| scaffold14851_2297703_SNP | 2297703 | C | A |
| S_9310536 \| \| scaffold14851_2297722_SNP | 2297722 | G | T |
| S_9310539 \| \| scaffold14851_2297870_SNP | 2297870 | G | A |
| S_9310580 \| \| scaffold14851_2298468_SNP | 2298468 | C | A |
| S_9310597 \| \| scaffold14851_2298572_SNP | 2298572 | T | G |
| S_9310601 \| \| scaffold14851_2298585_SNP | 2298585 | G | T |
| scaffold14851_2298855_SNP | 2298855 | T | C |
| scaffold14851_2298869_SNP | 2298869 | T | C |
| S_9310661 \| \| scaffold14851_2299217_SNP | 2299217 | T | A |
| S_9310748 \| \| scaffold14851_2299638_SNP | 2299638 | T | C |
| S_9310751 \| \| scaffold14851_2299661_SNP | 2299661 | G | C |
| S_9310762 \| \| scaffold14851_2299870_SNP | 2299870 | G | A |
| S_9310763 \| \| scaffold14851_2299878_SNP | 2299878 | G | T |
| S_9310768 \| \| scaffold14851_2299917_SNP | 2299917 | C | T |
| S_9310809 \| \| scaffold14851_2300590_SNP | 2300590 | C | T |
| S_9310837 \| \| scaffold14851_2300968_SNP | 2300968 | T | G |
| S_9310861 \| \| scaffold14851_2301239_SNP | 2301239 | T | A |
| S_9310926 \| \| scaffold14851_2302239_SNP | 2302239 | A | C |
| S_9310930 \| \| scaffold14851_2302264_SNP | 2302264 | C | T |
| S_9310949 \| \| scaffold14851_2302423_SNP | 2302423 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9310956 \| \| scaffold14851_2302486_SNP | 2302486 | T | G |
| S_9310964 \| \| scaffold14851_2302612_SNP | 2302612 | A | C |
| S_9310969 \| \| scaffold14851_2302713_SNP | 2302713 | G | C |
| S_9310973 \| \| scaffold14851_2302823_SNP | 2302823 | T | C |
| S_9310992 \| \| scaffold14851_2302980_SNP | 2302980 | G | A |
| S_9311010 \| \| scaffold14851_2303269_SNP | 2303269 | T | C |
| S_9311046 \| \| scaffold14851_2303787_SNP | 2303787 | G | A |
| S_9311196 \| \| scaffold14851_2305090_SNP | 2305090 | A | G |
| S_9311224 \| \| scaffold14851_2305525_SNP | 2305525 | C | T |
| S_9311351 \| \| scaffold14851_2307052_SNP | 2307052 | C | T |
| S_9311394 \| \| scaffold14851_2307522_SNP | 2307522 | G | A |
| S_9311405 \| \| scaffold14851_2307639_SNP | 2307639 | C | G |
| S_9311596 \| \| scaffold14851_2308906_SNP | 2308906 | T | C |
| S_9311775 \| \| scaffold14851_2311522_SNP | 2311522 | G | A |
| S_9311784 \| \| scaffold14851_2311649_SNP | 2311649 | A | G |
| S_9311898 \| \| scaffold14851_2312482_SNP | 2312482 | G | T |
| S_9313770 \| \| scaffold14851_2329449_SNP | 2329449 | C | T |
| S_9314320 \| \| scaffold14851_2333859_SNP | 2333859 | A | C |
| scaffold14851_2335527_SNP | 2335527 | G | C |
| S_9314591 \| \| scaffold14851_2335619_SNP | 2335619 | A | C |
| S_9314608 \| \| scaffold14851_2335716_SNP | 2335716 | C | T |
| S_9314710 \| \| scaffold14851_2336532_SNP | 2336532 | G | A |
| S_9314729 \| \| scaffold14851_2336757_SNP | 2336757 | T | G |
| S_9314755 \| \| scaffold14851_2337187_SNP | 2337187 | T | C |
| S_9314757 \| \| scaffold14851_2337201_SNP | 2337201 | A | G |
| S_9314779 \| \| scaffold14851_2337395_SNP | 2337395 | G | A |
| S_9314780 \| \| scaffold14851_2337396_SNP | 2337396 | T | A |
| S_9314784 \| \| scaffold14851_2337424_SNP | 2337424 | T | C |
| S_9314785 \| \| scaffold14851_2337431_SNP | 2337431 | G | A |
| S_9314810 \| \| scaffold14851_2337646_SNP | 2337646 | C | T |
| S_9314817 \| \| scaffold14851_2337676_SNP | 2337676 | C | T |
| S_9314819 \| \| scaffold14851_2337687_SNP | 2337687 | T | C |
| S_9314825 \| \| scaffold14851_2337737_SNP | 2337737 | G | A |
| S_9314896 \| \| scaffold14851_2337967_SNP | 2337967 | C | T |
| S_9314898 \| \| scaffold14851_2337975_SNP | 2337975 | C | T |
| S_9314914 \| \| scaffold14851_2338081_SNP | 2338081 | A | G |
| S_9314927 \| \| scaffold14851_2338210_SNP | 2338210 | T | C |
| S_9314936 \| \| scaffold14851_2338268_SNP | 2338268 | G | A |
| S_9314942 \| \| scaffold14851_2338343_SNP | 2338343 | T | A |
| S_9314976 \| \| scaffold14851_2338655_SNP | 2338655 | A | G |
| S_9314984 \| \| scaffold14851_2338707_SNP | 2338707 | A | G |
| S_9315012 \| \| scaffold14851_2338951_SNP | 2338951 | G | A |
| S_9315058 \| \| scaffold14851_2339259_SNP | 2339259 | C | T |
| S_9315110 \| \| scaffold14851_2339567_SNP | 2339567 | T | C |
| S_9315111 \| \| scaffold14851_2339568_SNP | 2339568 | C | T |
| S_9315121 \| \| scaffold14851_2339609_SNP | 2339609 | G | A |
| S_9315136 \| \| scaffold14851_2339781_SNP | 2339781 | A | G |
| S_9315160 \| \| scaffold14851_2339997_SNP | 2339997 | C | A |
| S_9315171 \| \| scaffold14851_2340069_SNP | 2340069 | A | G |
| S_9315174 \| \| scaffold14851_2340077_SNP | 2340077 | G | T |
| S_9315180 \| \| scaffold14851_2340128_SNP | 2340128 | C | A |
| S_9315184 \| \| scaffold14851_2340148_SNP | 2340148 | G | A |
| S_9315200 \| \| scaffold14851_2340281_SNP | 2340281 | A | G |
| S_9315221 \| \| scaffold14851_2340417_SNP | 2340417 | C | A |
| S_9315231 \| \| scaffold14851_2340483_SNP | 2340483 | A | G |
| S_9315234 \| \| scaffold14851_2340496_SNP | 2340496 | G | A |
| scaffold14851_2340646_SNP | 2340646 | C | T |
| S_9315261 \| \| scaffold14851_2340670_SNP | 2340670 | G | T |
| S_9315264 \| \| scaffold14851_2340690_SNP | 2340690 | G | A |
| scaffold14851_2340733_SNP | 2340733 | G | A |
| S_9315303 \| \| scaffold14851_2340813_SNP | 2340813 | C | T |
| S_9315424 \| \| scaffold14851_2341301_SNP | 2341301 | G | T |
| S_9315425 \| \| scaffold14851_2341309_SNP | 2341309 | A | G |
| S_9315488 \| \| scaffold14851_2342043_SNP | 2342043 | C | G |
| S_9315496 \| \| scaffold14851_2342096_SNP | 2342096 | G | A |
| S_9315497 \| \| scaffold14851_2342108_SNP | 2342108 | G | A |
| S_9315508 \| \| scaffold14851_2342288_SNP | 2342288 | G | A |
| S_9315510 \| \| scaffold14851_2342340_SNP | 2342340 | G | A |
| S_9315517 \| \| scaffold14851_2342451_SNP | 2342451 | C | T |
| S_9315522 \| \| scaffold14851_2342488_SNP | 2342488 | C | A |
| scaffold14851_2348330_SNP | 2348330 | G | C |
| S_9316562 \| \| scaffold14851_2350636_SNP | 2350636 | C | T |
| S_9316680 \| \| scaffold14851_2352233_SNP | 2352233 | C | A |
| S_9316759 \| \| scaffold14851_2353228_SNP | 2353228 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9316859 \| \| scaffold14851_2354642_SNP | 2354642 | G | T |
| S_9316866 \| \| scaffold14851_2354762_SNP | 2354762 | G | A |
| S_9316875 \| \| scaffold14851_2354898_SNP | 2354898 | T | A |
| S_9316907 \| \| scaffold14851_2355386_SNP | 2355386 | T | A |
| S_9316930 \| \| scaffold14851_2355735_SNP | 2355735 | G | A |
| S_9316931 \| \| scaffold14851_2355778_SNP | 2355778 | G | A |
| S_9317062 \| \| scaffold14851_2356934_SNP | 2356934 | T | G |
| S_9317098 \| \| scaffold14851_2357552_SNP | 2357552 | G | A |
| S_9317124 \| \| scaffold14851_2358186_SNP | 2358186 | T | A |
| S_9317185 \| \| scaffold14851_2358931_SNP | 2358931 | C | T |
| S_9317266 \| \| scaffold14851_2360155_SNP | 2360155 | G | A |
| S_9317414 \| \| scaffold14851_2361750_SNP | 2361750 | A | T |
| S_9317436 \| \| scaffold14851_2362244_SNP | 2362244 | T | C |
| S_9317944 \| \| scaffold14851_2368683_SNP | 2368683 | G | A |
| S_9318180 \| \| scaffold14851_2372287_SNP | 2372287 | G | C |
| S_9318183 \| \| scaffold14851_2372320_SNP | 2372320 | T | C |
| S_9318647 \| \| scaffold14851_2379298_SNP | 2379298 | C | A |
| S_9318654 \| \| scaffold14851_2379460_SNP | 2379460 | A | G |
| S_9318656 \| \| scaffold14851_2379471_SNP | 2379471 | T | C |
| S_9319108 \| \| scaffold14851_2385426_SNP | 2385426 | T | C |
| S_9319205 \| \| scaffold14851_2386348_SNP | 2386348 | G | A |
| S_9319249 \| \| scaffold14851_2387442_SNP | 2387442 | C | T |
| S_9319254 \| \| scaffold14851_2387544_SNP | 2387544 | G | A |
| S_9319256 \| \| scaffold14851_2387591_SNP | 2387591 | T | A |
| S_9319257 \| \| scaffold14851_2387593_SNP | 2387593 | C | T |
| S_9319262 \| \| scaffold14851_2387655_SNP | 2387655 | C | T |
| S_9319277 \| \| scaffold14851_2388003_SNP | 2388003 | C | A |
| S_9319337 \| \| scaffold14851_2388920_SNP | 2388920 | G | T |
| S_9319371 \| \| scaffold14851_2389262_SNP | 2389262 | G | T |
| S_9319712 \| \| scaffold14851_2393947_SNP | 2393947 | C | T |
| S_9320216 \| \| scaffold14851_2400340_SNP | 2400340 | A | G |
| S_9320346 \| \| scaffold14851_2402129_SNP | 2402129 | C | A |
| S_9320439 \| \| scaffold14851_2403477_SNP | 2403477 | T | C |
| S_9320556 \| \| scaffold14851_2405131_SNP | 2405131 | A | T |
| S_9320572 \| \| scaffold14851_2405365_SNP | 2405365 | C | A |
| S_9320621 \| \| scaffold14851_2405858_SNP | 2405858 | G | T |
| S_9321087 \| \| scaffold14851_2410727_SNP | 2410727 | T | G |
| S_9321110 \| \| scaffold14851_2410962_SNP | 2410962 | A | C |
| S_9321689 \| \| scaffold14851_2419952_SNP | 2419952 | C | A |
| S_9321706 \| \| scaffold14851_2420103_SNP | 2420103 | C | A |
| S_9321711 \| \| scaffold14851_2420228_SNP | 2420228 | A | G |
| S_9321713 \| \| scaffold14851_2420354_SNP | 2420354 | C | T |
| S_9321715 \| \| scaffold14851_2420363_SNP | 2420363 | G | T |
| S_9321716 \| \| scaffold14851_2420379_SNP | 2420379 | G | A |
| S_9321735 \| \| scaffold14851_2420670_SNP | 2420670 | G | T |
| S_9321736 \| \| scaffold14851_2420671_SNP | 2420671 | C | T |
| S_9321743 \| \| scaffold14851_2420778_SNP | 2420778 | G | A |
| S_9321744 \| \| scaffold14851_2420781_SNP | 2420781 | A | G |
| S_9321746 \| \| scaffold14851_2420841_SNP | 2420841 | G | A |
| S_9321837 \| \| scaffold14851_2421255_SNP | 2421255 | T | C |
| S_9321848 \| \| scaffold14851_2421455_SNP | 2421455 | C | T |
| S_9322077 \| \| scaffold14851_2423423_SNP | 2423423 | A | G |
| S_9322078 \| \| scaffold14851_2423442_SNP | 2423442 | A | T |
| S_9322079 \| \| scaffold14851_2423443_SNP | 2423443 | T | C |
| S_9322102 \| \| scaffold14851_2423678_SNP | 2423678 | G | C |
| S_9322109 \| \| scaffold14851_2423866_SNP | 2423866 | T | A |
| S_9322124 \| \| scaffold14851_2424105_SNP | 2424105 | C | T |
| S_9322142 \| \| scaffold14851_2424488_SNP | 2424488 | A | T |
| S_9322175 \| \| scaffold14851_2425019_SNP | 2425019 | T | G |
| S_9322185 \| \| scaffold14851_2425110_SNP | 2425110 | C | A |
| S_9322239 \| \| scaffold14851_2425768_SNP | 2425768 | A | T |
| S_9322240 \| \| scaffold14851_2425794_SNP | 2425794 | G | C |
| S_9322381 \| \| scaffold14851_2428146_SNP | 2428146 | C | T |
| S_9322384 \| \| scaffold14851_2428161_SNP | 2428161 | A | C |
| S_9322403 \| \| scaffold14851_2428243_SNP | 2428243 | A | T |
| S_9322404 \| \| scaffold14851_2428244_SNP | 2428244 | A | T |
| S_9322413 \| \| scaffold14851_2428426_SNP | 2428426 | A | G |
| S_9322481 \| \| scaffold14851_2429958_SNP | 2429958 | T | C |
| S_9322483 \| \| scaffold14851_2429998_SNP | 2429998 | A | G |
| S_9322491 \| \| scaffold14851_2430249_SNP | 2430249 | T | C |
| S_9322562 \| \| scaffold14851_2430532_SNP | 2430532 | A | T |
| S_9322563 \| \| scaffold14851_2430537_SNP | 2430537 | A | G |
| S_9322671 \| \| scaffold14851_2431904_SNP | 2431904 | G | C |
| S_9322712 \| \| scaffold14851_2432805_SNP | 2432805 | C | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9322736 \| \| scaffold14851_2433104_SNP | 2433104 | C | G |
| S_9322740 \| \| scaffold14851_2433148_SNP | 2433148 | A | T |
| S_9322741 \| \| scaffold14851_2433149_SNP | 2433149 | A | C |
| S_9322742 \| \| scaffold14851_2433161_SNP | 2433161 | A | T |
| S_9322744 \| \| scaffold14851_2433214_SNP | 2433214 | G | A |
| S_9322856 \| \| scaffold14851_2434419_SNP | 2434419 | C | A |
| S_9322859 \| \| scaffold14851_2434443_SNP | 2434443 | C | A |
| S_9323036 \| \| scaffold14851_2436340_SNP | 2436340 | A | C |
| S_9323070 \| \| scaffold14851_2436650_SNP | 2436650 | G | A |
| S_9323073 \| \| scaffold14851_2436662_SNP | 2436662 | T | A |
| S_9323085 \| \| scaffold14851_2436843_SNP | 2436843 | T | A |
| S_9323164 \| \| scaffold14851_2437569_SNP | 2437569 | G | A |
| S_9323179 \| \| scaffold14851_2437768_SNP | 2437768 | C | T |
| S_9323194 \| \| scaffold14851_2438023_SNP | 2438023 | T | A |
| S_9323220 \| \| scaffold14851_2438444_SNP | 2438444 | G | A |
| S_9323225 \| \| scaffold14851_2438482_SNP | 2438482 | A | C |
| S_9323234 \| \| scaffold14851_2438585_SNP | 2438585 | A | G |
| S_9323287 \| \| scaffold14851_2439500_SNP | 2439500 | A | G |
| S_9323288 \| \| scaffold14851_2439508_SNP | 2439508 | T | G |
| S_9323290 \| \| scaffold14851_2439513_SNP | 2439513 | G | A |
| S_9323331 \| \| scaffold14851_2440337_SNP | 2440337 | A | G |
| S_9323332 \| \| scaffold14851_2440344_SNP | 2440344 | T | G |
| S_9323334 \| \| scaffold14851_2440360_SNP | 2440360 | T | A |
| S_9323335 \| \| scaffold14851_2440384_SNP | 2440384 | T | C |
| S_9323341 \| \| scaffold14851_2440657_SNP | 2440657 | A | C |
| S_9323344 \| \| scaffold14851_2440671_SNP | 2440671 | A | T |
| S_9323360 \| \| scaffold14851_2440942_SNP | 2440942 | G | A |
| S_9323411 \| \| scaffold14851_2441924_SNP | 2441924 | T | G |
| S_9323499 \| \| scaffold14851_2443221_SNP | 2443221 | T | C |
| S_9323514 \| \| scaffold14851_2443489_SNP | 2443489 | A | G |
| S_9323566 \| \| scaffold14851_2444330_SNP | 2444330 | C | T |
| S_9323580 \| \| scaffold14851_2444477_SNP | 2444477 | T | C |
| S_9323588 \| \| scaffold14851_2444631_SNP | 2444631 | C | T |
| S_9323589 \| \| scaffold14851_2444632_SNP | 2444632 | G | T |
| S_9323591 \| \| scaffold14851_2444669_SNP | 2444669 | A | G |
| S_9323592 \| \| scaffold14851_2444680_SNP | 2444680 | T | C |
| S_9323702 \| \| scaffold14851_2445913_SNP | 2445913 | G | C |
| S_9323721 \| \| scaffold14851_2446171_SNP | 2446171 | C | T |
| S_9323726 \| \| scaffold14851_2446235_SNP | 2446235 | T | G |
| S_9323730 \| \| scaffold14851_2446279_SNP | 2446279 | C | A |
| S_9323735 \| \| scaffold14851_2446332_SNP | 2446332 | T | C |
| S_9323740 \| \| scaffold14851_2446378_SNP | 2446378 | T | G |
| S_9323741 \| \| scaffold14851_2446397_SNP | 2446397 | T | C |
| S_9323768 \| \| scaffold14851_2446756_SNP | 2446756 | A | T |
| S_9323784 \| \| scaffold14851_2446953_SNP | 2446953 | A | T |
| S_9323944 \| \| scaffold14851_2449023_SNP | 2449023 | T | A |
| S_9323952 \| \| scaffold14851_2449104_SNP | 2449104 | C | A |
| S_9323990 \| \| scaffold14851_2449625_SNP | 2449625 | A | G |
| S_9324011 \| \| scaffold14851_2449909_SNP | 2449909 | C | A |
| S_9324053 \| \| scaffold14851_2450530_SNP | 2450530 | A | T |
| S_9324086 \| \| scaffold14851_2451254_SNP | 2451254 | G | A |
| S_9324154 \| \| scaffold14851_2452219_SNP | 2452219 | A | T |
| S_9324187 \| \| scaffold14851_2452523_SNP | 2452523 | A | C |
| S_9324424 \| \| scaffold14851_2453522_SNP | 2453522 | A | T |
| S_9324425 \| \| scaffold14851_2453530_SNP | 2453530 | G | A |
| S_9324436 \| \| scaffold14851_2453722_SNP | 2453722 | T | C |
| S_9324442 \| \| scaffold14851_2453811_SNP | 2453811 | G | A |
| S_9324527 \| \| scaffold14851_2454693_SNP | 2454693 | T | C |
| S_9324528 \| \| scaffold14851_2454704_SNP | 2454704 | C | T |
| S_9324530 \| \| scaffold14851_2454741_SNP | 2454741 | A | G |
| S_9324547 \| \| scaffold14851_2454880_SNP | 2454880 | T | C |
| S_9324559 \| \| scaffold14851_2455025_SNP | 2455025 | C | T |
| S_9324635 \| \| scaffold14851_2455921_SNP | 2455921 | C | T |
| S_9324698 \| \| scaffold14851_2458015_SNP | 2458015 | A | T |
| S_9324733 \| \| scaffold14851_2458579_SNP | 2458579 | T | C |
| S_9324735 \| \| scaffold14851_2458600_SNP | 2458600 | G | T |
| S_9324777 \| \| scaffold14851_2459100_SNP | 2459100 | T | C |
| S_9324794 \| \| scaffold14851_2459382_SNP | 2459382 | G | T |
| S_9324802 \| \| scaffold14851_2459482_SNP | 2459482 | A | G |
| S_9324911 \| \| scaffold14851_2460686_SNP | 2460686 | A | G |
| S_9324916 \| \| scaffold14851_2460788_SNP | 2460788 | T | A |
| S_9324940 \| \| scaffold14851_2461341_SNP | 2461341 | T | A |
| S_9324968 \| \| scaffold14851_2461688_SNP | 2461688 | A | G |
| S_9324975 \| \| scaffold14851_2461793_SNP | 2461793 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9324981 \| \| scaffold14851_2461971_SNP | 2461971 | C | T |
| S_9324982 \| \| scaffold14851_2461988_SNP | 2461988 | A | G |
| S_9324985 \| \| scaffold14851_2462024_SNP | 2462024 | C | G |
| S_9325002 \| \| scaffold14851_2462253_SNP | 2462253 | T | C |
| S_9325067 \| \| scaffold14851_2462724_SNP | 2462724 | A | C |
| S_9325083 \| \| scaffold14851_2462984_SNP | 2462984 | C | A |
| S_9325097 \| \| scaffold14851_2463178_SNP | 2463178 | T | C |
| S_9325100 \| \| scaffold14851_2463246_SNP | 2463246 | C | A |
| S_9325123 \| \| scaffold14851_2463619_SNP | 2463619 | T | G |
| S_9325132 \| \| scaffold14851_2463765_SNP | 2463765 | C | T |
| S_9325139 \| \| scaffold14851_2463822_SNP | 2463822 | T | C |
| S_9325147 \| \| scaffold14851_2464030_SNP | 2464030 | T | C |
| S_9325150 \| \| scaffold14851_2464070_SNP | 2464070 | C | A |
| S_9325188 \| \| scaffold14851_2464774_SNP | 2464774 | A | C |
| S_9325213 \| \| scaffold14851_2465114_SNP | 2465114 | G | C |
| S_9325221 \| \| scaffold14851_2465216_SNP | 2465216 | C | T |
| S_9325222 \| \| scaffold14851_2465249_SNP | 2465249 | A | G |
| S_9325252 \| \| scaffold14851_2465715_SNP | 2465715 | G | T |
| S_9325281 \| \| scaffold14851_2465920_SNP | 2465920 | C | T |
| S_9325296 \| \| scaffold14851_2466161_SNP | 2466161 | T | C |
| S_9325297 \| \| scaffold14851_2466162_SNP | 2466162 | G | T |
| S_9325301 \| \| scaffold14851_2466197_SNP | 2466197 | A | G |
| S_9325325 \| \| scaffold14851_2466479_SNP | 2466479 | C | T |
| S_9325330 \| \| scaffold14851_2466530_SNP | 2466530 | A | G |
| S_9325348 \| \| scaffold14851_2466769_SNP | 2466769 | C | T |
| S_9325361 \| \| scaffold14851_2466902_SNP | 2466902 | A | C |
| S_9325362 \| \| scaffold14851_2466909_SNP | 2466909 | A | C |
| S_9325367 \| \| scaffold14851_2466938_SNP | 2466938 | A | T |
| S_9325440 \| \| scaffold14851_2467894_SNP | 2467894 | C | T |
| scaffold14851_2467940_SNP | 2467940 | T | C |
| S_9325505 \| \| scaffold14851_2468475_SNP | 2468475 | G | A |
| S_9325541 \| \| scaffold14851_2468875_SNP | 2468875 | C | A |
| S_9325544 \| \| scaffold14851_2468917_SNP | 2468917 | T | G |
| S_9325566 \| \| scaffold14851_2469145_SNP | 2469145 | G | A |
| S_9325586 \| \| scaffold14851_2469351_SNP | 2469351 | T | A |
| S_9325614 \| \| scaffold14851_2469819_SNP | 2469819 | T | G |
| S_9325626 \| \| scaffold14851_2470035_SNP | 2470035 | G | A |
| S_9325633 \| \| scaffold14851_2470148_SNP | 2470148 | T | G |
| S_9325645 \| \| scaffold14851_2470316_SNP | 2470316 | A | C |
| S_9325662 \| \| scaffold14851_2470700_SNP | 2470700 | T | A |
| S_9325693 \| \| scaffold14851_2471112_SNP | 2471112 | G | A |
| S_9325694 \| \| scaffold14851_2471117_SNP | 2471117 | G | C |
| S_9325704 \| \| scaffold14851_2471391_SNP | 2471391 | C | G |
| S_9325705 \| \| scaffold14851_2471401_SNP | 2471401 | A | T |
| S_9325706 \| \| scaffold14851_2471402_SNP | 2471402 | T | G |
| S_9325707 \| \| scaffold14851_2471407_SNP | 2471407 | A | G |
| S_9325708 \| \| scaffold14851_2471429_SNP | 2471429 | T | C |
| S_9325709 \| \| scaffold14851_2471454_SNP | 2471454 | T | A |
| S_9325710 \| \| scaffold14851_2471469_SNP | 2471469 | A | T |
| S_9325712 \| \| scaffold14851_2471487_SNP | 2471487 | A | T |
| S_9325716 \| \| scaffold14851_2471543_SNP | 2471543 | A | T |
| S_9325717 \| \| scaffold14851_2471548_SNP | 2471548 | G | A |
| S_9325720 \| \| scaffold14851_2471564_SNP | 2471564 | T | G |
| S_9325723 \| \| scaffold14851_2471586_SNP | 2471586 | T | C |
| S_9325731 \| \| scaffold14851_2471629_SNP | 2471629 | C | A |
| S_9325744 \| \| scaffold14851_2471819_SNP | 2471819 | G | A |
| S_9325759 \| \| scaffold14851_2472105_SNP | 2472105 | T | G |
| S_9325767 \| \| scaffold14851_2472200_SNP | 2472200 | A | C |
| S_9325768 \| \| scaffold14851_2472204_SNP | 2472204 | T | C |
| S_9325769 \| \| scaffold14851_2472224_SNP | 2472224 | C | T |
| S_9325778 \| \| scaffold14851_2472442_SNP | 2472442 | A | G |
| S_9325779 \| \| scaffold14851_2472444_SNP | 2472444 | A | T |
| S_9325780 \| \| scaffold14851_2472457_SNP | 2472457 | G | T |
| S_9325906 \| \| scaffold14851_2473752_SNP | 2473752 | T | A |
| S_9325934 \| \| scaffold14851_2474072_SNP | 2474072 | T | G |
| S_9325935 \| \| scaffold14851_2474073_SNP | 2474073 | C | A |
| S_9325936 \| \| scaffold14851_2474074_SNP | 2474074 | A | G |
| S_9326037 \| \| scaffold14851_2476611_SNP | 2476611 | T | C |
| S_9326043 \| \| scaffold14851_2476746_SNP | 2476746 | C | A |
| S_9326052 \| \| scaffold14851_2476816_SNP | 2476816 | A | T |
| S_9326057 \| \| scaffold14851_2476920_SNP | 2476920 | C | T |
| scaffold14851_2476921_SNP | 2476921 | G | T |
| S_9326100 \| \| scaffold14851_2477300_SNP | 2477300 | T | G |
| S_9326105 \| \| scaffold14851_2477375_SNP | 2477375 | A | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9326117 \|\| scaffold14851_2477563_SNP | 2477563 | A | G |
| S_9326131 \|\| scaffold14851_2477719_SNP | 2477719 | A | C |
| S_9326172 \|\| scaffold14851_2478437_SNP | 2478437 | A | C |
| S_9326219 \|\| scaffold14851_2478992_SNP | 2478992 | A | C |
| S_9326312 \|\| scaffold14851_2480134_SNP | 2480134 | T | C |
| S_9326405 \|\| scaffold14851_2481518_SNP | 2481518 | T | C |
| S_9326451 \|\| scaffold14851_2482318_SNP | 2482318 | T | A |
| S_9326458 \|\| scaffold14851_2482385_SNP | 2482385 | C | A |
| S_9326513 \|\| scaffold14851_2482505_SNP | 2482505 | A | G |
| S_9326539 \|\| scaffold14851_2482763_SNP | 2482763 | G | A |
| S_9326557 \|\| scaffold14851_2483051_SNP | 2483051 | G | A |
| S_9326558 \|\| scaffold14851_2483054_SNP | 2483054 | T | G |
| S_9326575 \|\| scaffold14851_2483337_SNP | 2483337 | T | A |
| S_9326578 \|\| scaffold14851_2483344_SNP | 2483344 | A | G |
| S_9326604 \|\| scaffold14851_2483603_SNP | 2483603 | G | A |
| S_9326621 \|\| scaffold14851_2483957_SNP | 2483957 | T | C |
| S_9326637 \|\| scaffold14851_2484215_SNP | 2484215 | A | T |
| S_9326638 \|\| scaffold14851_2484224_SNP | 2484224 | C | T |
| S_9326734 \|\| scaffold14851_2485450_SNP | 2485450 | C | G |
| S_9326742 \|\| scaffold14851_2485575_SNP | 2485575 | G | C |
| S_9326745 \|\| scaffold14851_2485611_SNP | 2485611 | A | T |
| S_9326817 \|\| scaffold14851_2486714_SNP | 2486714 | C | A |
| S_9326832 \|\| scaffold14851_2486984_SNP | 2486984 | T | C |
| S_9326837 \|\| scaffold14851_2487015_SNP | 2487015 | G | A |
| S_9326838 \|\| scaffold14851_2487016_SNP | 2487016 | A | G |
| S_9326839 \|\| scaffold14851_2487018_SNP | 2487018 | G | A |
| S_9326868 \|\| scaffold14851_2487498_SNP | 2487498 | G | A |
| S_9326889 \|\| scaffold14851_2487994_SNP | 2487994 | C | G |
| S_9326890 \|\| scaffold14851_2487996_SNP | 2487996 | G | C |
| S_9326891 \|\| scaffold14851_2488091_SNP | 2488091 | A | G |
| S_9326976 \|\| scaffold14851_2489479_SNP | 2489479 | G | A |
| S_9326997 \|\| scaffold14851_2489920_SNP | 2489920 | T | C |
| S_9327500 \|\| scaffold14851_2493193_SNP | 2493193 | T | C |
| scaffold14851_2493941_SNP | 2493941 | C | T |
| S_9327899 \|\| scaffold14851_2496056_SNP | 2496056 | T | C |
| S_9328167 \|\| scaffold14851_2497716_SNP | 2497716 | C | A |
| S_9328174 \|\| scaffold14851_2497773_SNP | 2497773 | G | A |
| S_9329064 \|\| scaffold14851_2503991_SNP | 2503991 | T | C |
| S_9329069 \|\| scaffold14851_2504020_SNP | 2504020 | T | G |
| S_9329081 \|\| scaffold14851_2504156_SNP | 2504156 | A | C |
| S_9329113 \|\| scaffold14851_2504564_SNP | 2504564 | G | T |
| S_9329114 \|\| scaffold14851_2504567_SNP | 2504567 | G | T |
| S_9329121 \|\| scaffold14851_2504669_SNP | 2504669 | C | A |
| S_9329122 \|\| scaffold14851_2504678_SNP | 2504678 | T | C |
| S_9329125 \|\| scaffold14851_2504757_SNP | 2504757 | G | C |
| S_9329128 \|\| scaffold14851_2504813_SNP | 2504813 | G | A |
| S_9329129 \|\| scaffold14851_2504816_SNP | 2504816 | A | G |
| S_9329219 \|\| scaffold14851_2505714_SNP | 2505714 | C | A |
| S_9329221 \|\| scaffold14851_2505722_SNP | 2505722 | G | C |
| S_9329222 \|\| scaffold14851_2505728_SNP | 2505728 | T | G |
| S_9329238 \|\| scaffold14851_2505861_SNP | 2505861 | T | G |
| S_9329239 \|\| scaffold14851_2505882_SNP | 2505882 | G | C |
| S_9329298 \|\| scaffold14851_2506792_SNP | 2506792 | G | T |
| S_9329301 \|\| scaffold14851_2506827_SNP | 2506827 | C | T |
| S_9329303 \|\| scaffold14851_2506899_SNP | 2506899 | A | T |
| S_9329304 \|\| scaffold14851_2506904_SNP | 2506904 | A | C |
| S_9329326 \|\| scaffold14851_2507127_SNP | 2507127 | C | T |
| S_9329328 \|\| scaffold14851_2507151_SNP | 2507151 | T | A |
| S_9329329 \|\| scaffold14851_2507159_SNP | 2507159 | G | C |
| S_9329429 \|\| scaffold14851_2508372_SNP | 2508372 | C | A |
| S_9329430 \|\| scaffold14851_2508429_SNP | 2508429 | A | G |
| S_9329456 \|\| scaffold14851_2508893_SNP | 2508893 | A | G |
| S_9329457 \|\| scaffold14851_2508930_SNP | 2508930 | C | G |
| S_9329459 \|\| scaffold14851_2508961_SNP | 2508961 | G | C |
| S_9329460 \|\| scaffold14851_2508965_SNP | 2508965 | T | C |
| S_9329477 \|\| scaffold14851_2509322_SNP | 2509322 | C | A |
| S_9329514 \|\| scaffold14851_2509913_SNP | 2509913 | T | G |
| S_9329515 \|\| scaffold14851_2509939_SNP | 2509939 | G | C |
| S_9329518 \|\| scaffold14851_2510111_SNP | 2510111 | A | G |
| S_9329519 \|\| scaffold14851_2510152_SNP | 2510152 | A | G |
| S_9329524 \|\| scaffold14851_2510222_SNP | 2510222 | A | C |
| S_9329526 \|\| scaffold14851_2510240_SNP | 2510240 | A | T |
| S_9329540 \|\| scaffold14851_2510497_SNP | 2510497 | A | C |
| S_9329607 \|\| scaffold14851_2511078_SNP | 2511078 | C | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9329651 \| \| scaffold14851_2511451_SNP | 2511451 | A | G |
| S_9329673 \| \| scaffold14851_2511689_SNP | 2511689 | T | G |
| S_9329755 \| \| scaffold14851_2512987_SNP | 2512987 | C | A |
| S_9329856 \| \| scaffold14851_2514069_SNP | 2514069 | C | T |
| S_9330018 \| \| scaffold14851_2516126_SNP | 2516126 | C | A |
| S_9330089 \| \| scaffold14851_2516710_SNP | 2516710 | T | G |
| S_9330100 \| \| scaffold14851_2516776_SNP | 2516776 | A | C |
| S_9330181 \| \| scaffold14851_2518257_SNP | 2518257 | T | C |
| S_9330219 \| \| scaffold14851_2518953_SNP | 2518953 | C | A |
| S_9330229 \| \| scaffold14851_2519176_SNP | 2519176 | T | A |
| S_9330240 \| \| scaffold14851_2519386_SNP | 2519386 | G | A |
| S_9330247 \| \| scaffold14851_2519478_SNP | 2519478 | T | G |
| S_9330250 \| \| scaffold14851_2519489_SNP | 2519489 | T | G |
| S_9330397 \| \| scaffold14851_2521501_SNP | 2521501 | G | A |
| S_9330398 \| \| scaffold14851_2521510_SNP | 2521510 | A | G |
| S_9330405 \| \| scaffold14851_2521658_SNP | 2521658 | T | C |
| S_9330406 \| \| scaffold14851_2521661_SNP | 2521661 | A | G |
| S_9330418 \| \| scaffold14851_2521850_SNP | 2521850 | C | T |
| S_9330429 \| \| scaffold14851_2521990_SNP | 2521990 | T | G |
| S_9330430 \| \| scaffold14851_2522006_SNP | 2522006 | G | T |
| scaffold14851_2522091_SNP | 2522091 | A | G |
| S_9330529 \| \| scaffold14851_2522749_SNP | 2522749 | G | A |
| S_9330530 \| \| scaffold14851_2522787_SNP | 2522787 | T | C |
| S_9330545 \| \| scaffold14851_2523023_SNP | 2523023 | A | G |
| S_9330551 \| \| scaffold14851_2523091_SNP | 2523091 | G | A |
| S_9330552 \| \| scaffold14851_2523093_SNP | 2523093 | G | C |
| S_9330556 \| \| scaffold14851_2523138_SNP | 2523138 | G | A |
| S_9330557 \| \| scaffold14851_2523181_SNP | 2523181 | A | T |
| S_9330558 \| \| scaffold14851_2523190_SNP | 2523190 | A | G |
| S_9330559 \| \| scaffold14851_2523205_SNP | 2523205 | G | A |
| S_9330560 \| \| scaffold14851_2523220_SNP | 2523220 | A | G |
| S_9330576 \| \| scaffold14851_2523384_SNP | 2523384 | C | G |
| S_9330601 \| \| scaffold14851_2523554_SNP | 2523554 | C | G |
| S_9330603 \| \| scaffold14851_2523594_SNP | 2523594 | A | T |
| S_9330610 \| \| scaffold14851_2523747_SNP | 2523747 | A | G |
| S_9330688 \| \| scaffold14851_2524868_SNP | 2524868 | G | T |
| S_9330692 \| \| scaffold14851_2524919_SNP | 2524919 | T | C |
| S_9330695 \| \| scaffold14851_2524935_SNP | 2524935 | T | C |
| S_9330699 \| \| scaffold14851_2525010_SNP | 2525010 | C | T |
| S_9330701 \| \| scaffold14851_2525042_SNP | 2525042 | C | T |
| S_9330708 \| \| scaffold14851_2525094_SNP | 2525094 | C | T |
| S_9330728 \| \| scaffold14851_2525352_SNP | 2525352 | G | C |
| S_9330731 \| \| scaffold14851_2525363_SNP | 2525363 | G | C |
| S_9330733 \| \| scaffold14851_2525368_SNP | 2525368 | G | A |
| S_9330734 \| \| scaffold14851_2525370_SNP | 2525370 | G | A |
| S_9330778 \| \| scaffold14851_2525945_SNP | 2525945 | T | C |
| S_9330799 \| \| scaffold14851_2526179_SNP | 2526179 | T | C |
| S_9330812 \| \| scaffold14851_2526524_SNP | 2526524 | A | C |
| S_9330894 \| \| scaffold14851_2527635_SNP | 2527635 | G | A |
| S_9330899 \| \| scaffold14851_2527750_SNP | 2527750 | A | T |
| S_9330907 \| \| scaffold14851_2527819_SNP | 2527819 | C | A |
| S_9330911 \| \| scaffold14851_2527864_SNP | 2527864 | T | G |
| S_9331004 \| \| scaffold14851_2528991_SNP | 2528991 | A | G |
| S_9331083 \| \| scaffold14851_2529846_SNP | 2529846 | A | T |
| S_9331085 \| \| scaffold14851_2529966_SNP | 2529966 | C | A |
| S_9331106 \| \| scaffold14851_2530681_SNP | 2530681 | T | G |
| S_9331116 \| \| scaffold14851_2530797_SNP | 2530797 | C | T |
| S_9331249 \| \| scaffold14851_2532490_SNP | 2532490 | C | G |
| S_9331290 \| \| scaffold14851_2533230_SNP | 2533230 | T | A |
| S_9331296 \| \| scaffold14851_2533379_SNP | 2533379 | C | T |
| S_9331312 \| \| scaffold14851_2533568_SNP | 2533568 | A | T |
| S_9331328 \| \| scaffold14851_2533774_SNP | 2533774 | C | A |
| S_9331373 \| \| scaffold14851_2534192_SNP | 2534192 | T | C |
| S_9331377 \| \| scaffold14851_2534360_SNP | 2534360 | T | C |
| S_9331420 \| \| scaffold14851_2535256_SNP | 2535256 | A | G |
| S_9331441 \| \| scaffold14851_2535693_SNP | 2535693 | T | C |
| S_9331447 \| \| scaffold14851_2535863_SNP | 2535863 | C | A |
| S_9331454 \| \| scaffold14851_2536065_SNP | 2536065 | A | C |
| S_9331466 \| \| scaffold14851_2536215_SNP | 2536215 | T | C |
| S_9331521 \| \| scaffold14851_2537548_SNP | 2537548 | T | C |
| S_9331535 \| \| scaffold14851_2537709_SNP | 2537709 | C | T |
| S_9331547 \| \| scaffold14851_2537876_SNP | 2537876 | C | G |
| S_9331549 \| \| scaffold14851_2537909_SNP | 2537909 | G | C |
| S_9331551 \| \| scaffold14851_2537955_SNP | 2537955 | A | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9331587 \| \| scaffold14851_2538205_SNP | 2538205 | T | G |
| S_9331614 \| \| scaffold14851_2538606_SNP | 2538606 | T | C |
| S_9331615 \| \| scaffold14851_2538608_SNP | 2538608 | G | A |
| S_9331617 \| \| scaffold14851_2538628_SNP | 2538628 | C | A |
| S_9331642 \| \| scaffold14851_2539059_SNP | 2539059 | C | T |
| S_9331815 \| \| scaffold14851_2540909_SNP | 2540909 | T | C |
| S_9331836 \| \| scaffold14851_2541147_SNP | 2541147 | A | G |
| S_9331853 \| \| scaffold14851_2541337_SNP | 2541337 | G | A |
| S_9331856 \| \| scaffold14851_2541368_SNP | 2541368 | A | T |
| S_9331916 \| \| scaffold14851_2542061_SNP | 2542061 | C | T |
| S_9331944 \| \| scaffold14851_2542730_SNP | 2542730 | T | C |
| S_9331948 \| \| scaffold14851_2542788_SNP | 2542788 | C | T |
| S_9331977 \| \| scaffold14851_2543164_SNP | 2543164 | T | A |
| S_9332105 \| \| scaffold14851_2544694_SNP | 2544694 | T | C |
| S_9332179 \| \| scaffold14851_2545871_SNP | 2545871 | G | A |
| S_9332192 \| \| scaffold14851_2546072_SNP | 2546072 | G | C |
| S_9332203 \| \| scaffold14851_2546263_SNP | 2546263 | T | C |
| S_9332265 \| \| scaffold14851_2546668_SNP | 2546668 | T | C |
| S_9332309 \| \| scaffold14851_2547017_SNP | 2547017 | T | C |
| S_9332311 \| \| scaffold14851_2547028_SNP | 2547028 | G | A |
| S_9332420 \| \| scaffold14851_2548969_SNP | 2548969 | A | G |
| S_9332424 \| \| scaffold14851_2549021_SNP | 2549021 | T | C |
| $_9332425 \| \| scaffold14851_2549036_SNP | 2549036 | G | A |
| S_9332427 \| \| scaffold14851_2549089_SNP | 2549089 | C | T |
| S_9332452 \| \| scaffold14851_2549242_SNP | 2549242 | A | G |
| S_9332453 \| \| scaffold14851_2549254_SNP | 2549254 | A | G |
| S_9332511 \| \| scaffold14851_2550221_SNP | 2550221 | G | A |
| S_9332518 \| \| scaffold14851_2550280_SNP | 2550280 | A | T |
| S_9332539 \| \| scaffold14851_2550500_SNP | 2550500 | A | T |
| S_9332548 \| \| scaffold14851_2550629_SNP | 2550629 | A | G |
| S_9332643 \| \| scaffold14851_2552435_SNP | 2552435 | C | T |
| S_9332870 \| \| scaffold14851_2554734_SNP | 2554734 | C | G |
| S_9332931 \| \| scaffold14851_2555596_SNP | 2555596 | G | T |
| S_9333093 \| \| scaffold14851_2557735_SNP | 2557735 | A | G |
| S_9333209 \| \| scaffold14851_2559530_SNP | 2559530 | C | A |
| S_9333278 \| \| scaffold14851_2560651_SNP | 2560651 | T | G |
| S_9333396 \| \| scaffold14851_2562023_SNP | 2562023 | G | A |
| S_9333546 \| \| scaffold14851_2564291_SNP | 2564291 | A | T |
| S_9333669 \| \| scaffold14851_2565886_SNP | 2565886 | C | T |
| S_9333680 \| \| scaffold14851_2566171_SNP | 2566171 | C | T |
| S_9333720 \| \| scaffold14851_2566563_SNP | 2566563 | A | G |
| S_9333723 \| \| scaffold14851_2566578_SNP | 2566578 | C | T |
| S_9333727 \| \| scaffold14851_2566692_SNP | 2566692 | G | C |
| S_9333728 \| \| scaffold14851_2566695_SNP | 2566695 | C | G |
| S_9333789 \| \| scaffold14851_2567776_SNP | 2567776 | G | A |
| S_9333791 \| \| scaffold14851_2567829_SNP | 2567829 | G | T |
| S_9333794 \| \| scaffold14851_2567913_SNP | 2567913 | T | C |
| S_9333992 \| \| scaffold14851_2571365_SNP | 2571365 | T | G |
| S_9334030 \| \| scaffold14851_2571716_SNP | 2571716 | A | G |
| S_9334368 \| \| scaffold14851_2577430_SNP | 2577430 | G | T |
| S_9334490 \| \| scaffold14851_2578646_SNP | 2578646 | T | A |
| S_9334681 \| \| scaffold14851_2581676_SNP | 2581676 | A | G |
| $_9334688 \| \| scaffold14851_2581918_SNP | 2581918 | G | A |
| S_9334690 \| \| scaffold14851_2581925_SNP | 2581925 | T | A |
| S_9334691 \| \| scaffold14851_2581927_SNP | 2581927 | T | A |
| S_9334722 \| \| scaffold14851_2582034_SNP | 2582034 | C | T |
| S_9334789 \| \| scaffold14851_2583086_SNP | 2583086 | T | A |
| S_9335504 \| \| scaffold14851_2593171_SNP | 2593171 | G | T |
| S_9335529 \| \| scaffold14851_2593286_SNP | 2593286 | G | A |
| S_9335531 \| \| scaffold14851_2593313_SNP | 2593313 | C | A |
| S_9335571 \| \| scaffold14851_2593954_SNP | 2593954 | A | G |
| S_9335687 \| \| scaffold14851_2595432_SNP | 2595432 | G | A |
| S_9335878 \| \| scaffold14851_2599531_SNP | 2599531 | C | A |
| S_9335914 \| \| scaffold14851_2599931_SNP | 2599931 | G | C |
| S_9335916 \| \| scaffold14851_2599950_SNP | 2599950 | G | T |
| S_9336119 \| \| scaffold14851_2605224_SNP | 2605224 | T | A |
| S_9337265 \| \| scaffold14851_2617714_SNP | 2617714 | T | A |
| S_9337345 \| \| scaffold14851_2618724_SNP | 2618724 | G | A |
| S_9338568 \| \| scaffold14851_2635690_SNP | 2635690 | T | C |
| S_9338717 \| \| scaffold14851_2637861_SNP | 2637861 | A | T |
| S_9339171 \| \| scaffold14851_2644707_SNP | 2644707 | T | C |
| S_9339177 \| \| scaffold14851_2644742_SNP | 2644742 | A | T |
| S_9339179 \| \| scaffold14851_2644781_SNP | 2644781 | C | T |
| S_9339180 \| \| scaffold14851_2644782_SNP | 2644782 | C | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9339181 \| \| scaffold14851_2644783_SNP | 2644783 | C | T |
| S_9339182 \| \| scaffold14851_2644800_SNP | 2644800 | A | C |
| S_9339215 \| \| scaffold14851_2644893_SNP | 2644893 | G | A |
| S_9339248 \| \| scaffold14851_2645036_SNP | 2645036 | C | T |
| S_9339260 \| \| scaffold14851_2645092_SNP | 2645092 | C | T |
| S_9339274 \| \| scaffold14851_2645177_SNP | 2645177 | A | C |
| S_9339462 \| \| scaffold14851_2647319_SNP | 2647319 | A | T |
| S_9339472 \| \| scaffold14851_2647449_SNP | 2647449 | C | T |
| S_9339533 \| \| scaffold14851_2648147_SNP | 2648147 | A | T |
| S_9339534 \| \| scaffold14851_2648174_SNP | 2648174 | C | T |
| S_9339539 \| \| scaffold14851_2648265_SNP | 2648265 | A | G |
| S_9339614 \| \| scaffold14851_2648503_SNP | 2648503 | A | G |
| S_9339652 \| \| scaffold14851_2648591_SNP | 2648591 | A | T |
| S_9339653 \| \| scaffold14851_2648592_SNP | 2648592 | A | T |
| S_9339654 \| \| scaffold14851_2648593_SNP | 2648593 | A | T |
| S_9339656 \| \| scaffold14851_2648595_SNP | 2648595 | G | T |
| S_9339684 \| \| scaffold14851_2648817_SNP | 2648817 | C | A |
| S_9340072 \| \| scaffold14851_2654380_SNP | 2654380 | T | C |
| S_9340121 \| \| scaffold14851_2655252_SNP | 2655252 | A | G |
| S_9340154 \| \| scaffold14851_2655830_SNP | 2655830 | A | T |
| scaffold14851_2655831_SNP | 2655831 | T | A |
| scaffold14851_2655832_SNP | 2655832 | A | T |
| S_9340159 \| \| scaffold14851_2655881_SNP | 2655881 | T | G |
| S_9340164 \| \| scaffold14851_2655953_SNP | 2655953 | A | G |
| S_9340170 \| \| scaffold14851_2656050_SNP | 2656050 | C | T |
| S_9340184 \| \| scaffold14851_2656267_SNP | 2656267 | C | T |
| S_9340187 \| \| scaffold14851_2656281_SNP | 2656281 | T | A |
| S_9340267 \| \| scaffold14851_2656944_SNP | 2656944 | T | A |
| S_9340328 \| \| scaffold14851_2658091_SNP | 2658091 | T | A |
| S_9340366 \| \| scaffold14851_2658634_SNP | 2658634 | A | T |
| S_9340367 \| \| scaffold14851_2658635_SNP | 2658635 | C | T |
| S_9340368 \| \| scaffold14851_2658655_SNP | 2658655 | G | C |
| S_9340390 \| \| scaffold14851_2659143_SNP | 2659143 | C | T |
| S_9340400 \| \| scaffold14851_2659248_SNP | 2659248 | A | C |
| S_9340401 \| \| scaffold14851_2659253_SNP | 2659253 | G | A |
| S_9340403 \| \| scaffold14851_2659260_SNP | 2659260 | T | C |
| S_9340405 \| \| scaffold14851_2659294_SNP | 2659294 | C | T |
| S_9340406 \| \| scaffold14851_2659304_SNP | 2659304 | C | T |
| S_9340466 \| \| scaffold14851_2659590_SNP | 2659590 | A | G |
| S_9340474 \| \| scaffold14851_2659648_SNP | 2659648 | C | T |
| S_9340496 \| \| scaffold14851_2659862_SNP | 2659862 | G | T |
| S_9340505 \| \| scaffold14851_2659947_SNP | 2659947 | C | T |
| S_9340527 \| \| scaffold14851_2660339_SNP | 2660339 | G | T |
| S_9340530 \| \| scaffold14851_2660422_SNP | 2660422 | A | G |
| S_9340552 \| \| scaffold14851_2660721_SNP | 2660721 | A | G |
| S_9340555 \| \| scaffold14851_2660758_SNP | 2660758 | T | G |
| S_9340587 \| \| scaffold14851_2661423_SNP | 2661423 | T | C |
| S_9340591 \| \| scaffold14851_2661480_SNP | 2661480 | T | A |
| S_9340599 \| \| scaffold14851_2661594_SNP | 2661594 | C | T |
| S_9340603 \| \| scaffold14851_2661688_SNP | 2661688 | C | T |
| S_9340606 \| \| scaffold14851_2661731_SNP | 2661731 | T | G |
| S_9340621 \| \| scaffold14851_2661874_SNP | 2661874 | T | G |
| scaffold14851_2662318_SNP | 2662318 | A | G |
| scaffold14851_2662320_SNP | 2662320 | G | T |
| scaffold14851_2662321_SNP | 2662321 | T | G |
| scaffold14851_2662322_SNP | 2662322 | G | A |
| S_9340649 \| \| scaffold14851_2662427_SNP | 2662427 | C | T |
| S_9340655 \| \| scaffold14851_2662623_SNP | 2662623 | A | G |
| S_9340660 \| \| scaffold14851_2662650_SNP | 2662650 | C | A |
| S_9340665 \| \| scaffold14851_2662723_SNP | 2662723 | C | A |
| S_9340668 \| \| scaffold14851_2662772_SNP | 2662772 | C | G |
| S_9340689 \| \| scaffold14851_2663154_SNP | 2663154 | G | A |
| S_9340714 \| \| scaffold14851_2663578_SNP | 2663578 | G | C |
| S_9340765 \| \| scaffold14851_2664576_SNP | 2664576 | G | C |
| S_9340769 \| \| scaffold14851_2664648_SNP | 2664648 | C | T |
| S_9340770 \| \| scaffold14851_2664650_SNP | 2664650 | A | C |
| S_9340802 \| \| scaffold14851_2665252_SNP | 2665252 | A | G |
| S_9340803 \| \| scaffold14851_2665257_SNP | 2665257 | T | C |
| S_9340804 \| \| scaffold14851_2665261_SNP | 2665261 | T | G |
| S_9340828 \| \| scaffold14851_2665888_SNP | 2665888 | A | G |
| S_9340830 \| \| scaffold14851_2665986_SNP | 2665986 | A | G |
| S_9340834 \| \| scaffold14851_2666131_SNP | 2666131 | T | C |
| S_9340836 \| \| scaffold14851_2666164_SNP | 2666164 | C | T |
| S_9340868 \| \| scaffold14851_2666501_SNP | 2666501 | T | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9340900 \| \| scaffold14851_2667058_SNP | 2667058 | C | A |
| S_9340921 \| \| scaffold14851_2667530_SNP | 2667530 | C | G |
| S_9340934 \| \| scaffold14851_2667749_SNP | 2667749 | C | T |
| S_9341227 \| \| scaffold14851_2672251_SNP | 2672251 | A | T |
| S_9341273 \| \| scaffold14851_2673148_SNP | 2673148 | A | C |
| S_9341281 \| \| scaffold14851_2673228_SNP | 2673228 | G | A |
| S_9341282 \| \| scaffold14851_2673229_SNP | 2673229 | C | A |
| S_9341285 \| \| scaffold14851_2673291_SNP | 2673291 | T | C |
| S_9341312 \| \| scaffold14851_2673576_SNP | 2673576 | T | A |
| S_9341327 \| \| scaffold14851_2673716_SNP | 2673716 | A | G |
| S_9341328 \| \| scaffold14851_2673724_SNP | 2673724 | G | A |
| S_9341347 \| \| scaffold14851_2674093_SNP | 2674093 | A | C |
| S_9341348 \| \| scaffold14851_2674095_SNP | 2674095 | A | G |
| S_9341371 \| \| scaffold14851_2674708_SNP | 2674708 | A | G |
| S_9341373 \| \| scaffold14851_2674725_SNP | 2674725 | T | C |
| S_9341394 \| \| scaffold14851_2675107_SNP | 2675107 | C | T |
| S_9341396 \| \| scaffold14851_2675131_SNP | 2675131 | C | T |
| S_9341400 \| \| scaffold14851_2675198_SNP | 2675198 | C | T |
| S_9341401 \| \| scaffold14851_2675204_SNP | 2675204 | A | G |
| S_9341436 \| \| scaffold14851_2675826_SNP | 2675826 | A | G |
| S_9341444 \| \| scaffold14851_2676077_SNP | 2676077 | T | A |
| S_9341453 \| \| scaffold14851_2676142_SNP | 2676142 | C | A |
| S_9341466 \| \| scaffold14851_2676487_SNP | 2676487 | A | T |
| S_9341497 \| \| scaffold14851_2676957_SNP | 2676957 | A | T |
| S_9341499 \| \| scaffold14851_2676991_SNP | 2676991 | C | T |
| S_9341503 \| \| scaffold14851_2677177_SNP | 2677177 | A | C |
| S_9341579 \| \| scaffold14851_2678333_SNP | 2678333 | T | G |
| S_9341657 \| \| scaffold14851_2679052_SNP | 2679052 | T | A |
| S_9341818 \| \| scaffold14851_2680986_SNP | 2680986 | T | G |
| S_9341899 \| \| scaffold14851_2681850_SNP | 2681850 | A | T |
| S_9342122 \| \| scaffold14851_2684803_SNP | 2684803 | G | T |
| S_9342123 \| \| scaffold14851_2684807_SNP | 2684807 | T | G |
| S_9342124 \| \| scaffold14851_2684813_SNP | 2684813 | G | A |
| S_9342127 \| \| scaffold14851_2684862_SNP | 2684862 | A | T |
| S_9342134 \| \| scaffold14851_2685060_SNP | 2685060 | A | G |
| S_9342137 \| \| scaffold14851_2685098_SNP | 2685098 | T | G |
| S_9342196 \| \| scaffold14851_2685591_SNP | 2685591 | G | A |
| S_9342233 \| \| scaffold14851_2686133_SNP | 2686133 | A | G |
| S_9342263 \| \| scaffold14851_2686460_SNP | 2686460 | T | C |
| S_9342285 \| \| scaffold14851_2686657_SNP | 2686657 | C | T |
| S_9342286 \| \| scaffold14851_2686661_SNP | 2686661 | A | G |
| S_9342328 \| \| scaffold14851_2687289_SNP | 2687289 | G | A |
| S_9342401 \| \| scaffold14851_2687798_SNP | 2687798 | T | C |
| S_9342460 \| \| scaffold14851_2688668_SNP | 2688668 | A | T |
| S_9342486 \| \| scaffold14851_2688831_SNP | 2688831 | A | C |
| S_9342567 \| \| scaffold14851_2690027_SNP | 2690027 | A | G |
| S_9342659 \| \| scaffold14851_2691488_SNP | 2691488 | T | A |
| S_9342661 \| \| scaffold14851_2691490_SNP | 2691490 | T | C |
| S_9342743 \| \| scaffold14851_2692715_SNP | 2692715 | G | A |
| S_9342777 \| \| scaffold14851_2693149_SNP | 2693149 | C | G |
| S_9342780 \| \| scaffold14851_2693264_SNP | 2693264 | T | G |
| S_9342854 \| \| scaffold14851_2694135_SNP | 2694135 | T | C |
| S_9342855 \| \| scaffold14851_2694136_SNP | 2694136 | C | T |
| S_9342859 \| \| scaffold14851_2694269_SNP | 2694269 | T | C |
| S_9342861 \| \| scaffold14851_2694284_SNP | 2694284 | G | A |
| S_9342862 \| \| scaffold14851_2694296_SNP | 2694296 | T | C |
| S_9342869 \| \| scaffold14851_2694429_SNP | 2694429 | T | G |
| S_9342900 \| \| scaffold14851_2694544_SNP | 2694544 | G | T |
| S_9342908 \| \| scaffold14851_2694619_SNP | 2694619 | A | T |
| S_9342913 \| \| scaffold14851_2694642_SNP | 2694642 | C | T |
| S_9342914 \| \| scaffold14851_2694685_SNP | 2694685 | T | C |
| S_9342918 \| \| scaffold14851_2694858_SNP | 2694858 | A | T |
| S_9343067 \| \| scaffold14851_2696490_SNP | 2696490 | T | C |
| S_9343096 \| \| scaffold14851_2696836_SNP | 2696836 | A | T |
| S_9343106 \| \| scaffold14851_2697041_SNP | 2697041 | C | T |
| scaffold14851_2697670_SNP | 2697670 | G | T |
| S_9343159 \| \| scaffold14851_2697763_SNP | 2697763 | A | C |
| S_9343203 \| \| scaffold14851_2698419_SNP | 2698419 | G | T |
| S_9343205 \| \| scaffold14851_2698440_SNP | 2698440 | T | A |
| S_9343239 \| \| scaffold14851_2699024_SNP | 2699024 | C | T |
| S_9344946 \| \| scaffold14851_2704836_SNP | 2704836 | A | G |
| S_9344960 \| \| scaffold14851_2704901_SNP | 2704901 | G | A |
| S_9345033 \| \| scaffold14851_2705368_SNP | 2705368 | A | T |
| S_9345035 \| \| scaffold14851_2705418_SNP | 2705418 | T | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9345238 \| \| scaffold14851_2707018_SNP | 2707018 | T | C |
| S_9345332 \| \| scaffold14851_2707681_SNP | 2707681 | C | A |
| S_9345366 \| \| scaffold14851_2708289_SNP | 2708289 | C | T |
| S_9345384 \| \| scaffold14851_2708444_SNP | 2708444 | C | T |
| S_9345389 \| \| scaffold14851_2708493_SNP | 2708493 | C | A |
| S_9345393 \| \| scaffold14851_2708524_SNP | 2708524 | T | C |
| S_9345404 \| \| scaffold14851_2708678_SNP | 2708678 | T | C |
| S_9345412 \| \| scaffold14851_2708838_SNP | 2708838 | A | G |
| S_9345413 \| \| scaffold14851_2708844_SNP | 2708844 | G | T |
| S_9345414 \| \| scaffold14851_2708850_SNP | 2708850 | A | G |
| S_9345419 \| \| scaffold14851_2708945_SNP | 2708945 | G | C |
| S_9345466 \| \| scaffold14851_2709537_SNP | 2709537 | A | C |
| S_9345467 \| \| scaffold14851_2709538_SNP | 2709538 | G | A |
| S_9345488 \| \| scaffold14851_2709826_SNP | 2709826 | T | G |
| S_9345496 \| \| scaffold14851_2709901_SNP | 2709901 | A | G |
| S_9345530 \| \| scaffold14851_2710331_SNP | 2710331 | C | T |
| S_9345532 \| \| scaffold14851_2710340_SNP | 2710340 | G | A |
| S_9345534 \| \| scaffold14851_2710348_SNP | 2710348 | A | T |
| S_9345535 \| \| scaffold14851_2710349_SNP | 2710349 | G | A |
| S_9345630 \| \| scaffold14851_2711280_SNP | 2711280 | T | C |
| S_9345631 \| \| scaffold14851_2711281_SNP | 2711281 | G | T |
| S_9345683 \| \| scaffold14851_2711655_SNP | 2711655 | G | T |
| S_9345713 \| \| scaffold14851_2712187_SNP | 2712187 | T | C |
| S_9345795 \| \| scaffold14851_2712553_SNP | 2712553 | T | C |
| S_9345804 \| \| scaffold14851_2712691_SNP | 2712691 | T | G |
| S_9345807 \| \| scaffold14851_2712718_SNP | 2712718 | A | C |
| S_9345809 \| \| scaffold14851_2712723_SNP | 2712723 | G | A |
| S_9345929 \| \| scaffold14851_2714590_SNP | 2714590 | A | C |
| S_9345945 \| \| scaffold14851_2714741_SNP | 2714741 | A | T |
| S_9345988 \| \| scaffold14851_2715251_SNP | 2715251 | G | A |
| S_9346047 \| \| scaffold14851_2715905_SNP | 2715905 | T | C |
| S_9346070 \| \| scaffold14851_2716105_SNP | 2716105 | C | T |
| S_9346083 \| \| scaffold14851_2716348_SNP | 2716348 | A | G |
| S_9346084 \| \| scaffold14851_2716377_SNP | 2716377 | C | T |
| S_9346128 \| \| scaffold14851_2717016_SNP | 2717016 | A | T |
| S_9346214 \| \| scaffold14851_2718020_SNP | 2718020 | A | G |
| S_9346369 \| \| scaffold14851_2719718_SNP | 2719718 | C | G |
| S_9346403 \| \| scaffold14851_2719943_SNP | 2719943 | C | A |
| S_9346480 \| \| scaffold14851_2720936_SNP | 2720936 | G | A |
| S_9346496 \| \| scaffold14851_2721123_SNP | 2721123 | C | T |
| S_9346498 \| \| scaffold14851_2721130_SNP | 2721130 | A | G |
| S_9346513 \| \| scaffold14851_2721520_SNP | 2721520 | G | A |
| S_9346560 \| \| scaffold14851_2722772_SNP | 2722772 | C | G |
| S_9346562 \| \| scaffold14851_2722776_SNP | 2722776 | C | T |
| S_9346577 \| \| scaffold14851_2722919_SNP | 2722919 | G | T |
| S_9346578 \| \| scaffold14851_2722953_SNP | 2722953 | T | C |
| S_9346585 \| \| scaffold14851_2723015_SNP | 2723015 | C | A |
| S_9346629 \| \| scaffold14851_2723743_SNP | 2723743 | G | A |
| S_9346641 \| \| scaffold14851_2724100_SNP | 2724100 | A | C |
| S_9346649 \| \| scaffold14851_2724253_SNP | 2724253 | T | A |
| S_9346760 \| \| scaffold14851_2725336_SNP | 2725336 | C | G |
| S_9346769 \| \| scaffold14851_2725480_SNP | 2725480 | G | C |
| S_9346773 \| \| scaffold14851_2725589_SNP | 2725589 | T | C |
| S_9346870 \| \| scaffold14851_2726713_SNP | 2726713 | C | T |
| S_9346873 \| \| scaffold14851_2726779_SNP | 2726779 | A | T |
| S_9346874 \| \| scaffold14851_2726784_SNP | 2726784 | T | G |
| S_9346886 \| \| scaffold14851_2726919_SNP | 2726919 | C | G |
| S_9346914 \| \| scaffold14851_2727230_SNP | 2727230 | G | A |
| S_9346966 \| \| scaffold14851_2727940_SNP | 2727940 | T | G |
| S_9346973 \| \| scaffold14851_2728007_SNP | 2728007 | T | C |
| S_9346976 \| \| scaffold14851_2728020_SNP | 2728020 | G | A |
| S_9347039 \| \| scaffold14851_2728891_SNP | 2728891 | T | C |
| S_9347068 \| \| scaffold14851_2729346_SNP | 2729346 | A | T |
| S_9347097 \| \| scaffold14851_2729782_SNP | 2729782 | C | A |
| S_9347130 \| \| scaffold14851_2730110_SNP | 2730110 | C | G |
| S_9347131 \| \| scaffold14851_2730111_SNP | 2730111 | A | T |
| S_9347160 \| \| scaffold14851_2730202_SNP | 2730202 | C | T |
| S_9347169 \| \| scaffold14851_2730356_SNP | 2730356 | G | A |
| S_9347170 \| \| scaffold14851_2730364_SNP | 2730364 | C | T |
| S_9347195 \| \| scaffold14851_2730619_SNP | 2730619 | A | G |
| S_9347200 \| \| scaffold14851_2730652_SNP | 2730652 | T | C |
| S_9347207 \| \| scaffold14851_2730712_SNP | 2730712 | G | C |
| S_9347208 \| \| scaffold14851_2730714_SNP | 2730714 | T | A |
| S_9347210 \| \| scaffold14851_2730725_SNP | 2730725 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9347212 \| \| scaffold14851_2730731_SNP | 2730731 | A | G |
| S_9347215 \| \| scaffold14851_2730780_SNP | 2730780 | A | G |
| S_9347242 \| \| scaffold14851_2731046_SNP | 2731046 | T | C |
| S_9347249 \| \| scaffold14851_2731162_SNP | 2731162 | A | G |
| S_9347287 \| \| scaffold14851_2731352_SNP | 2731352 | A | T |
| S_9347293 \| \| scaffold14851_2731386_SNP | 2731386 | A | T |
| S_9347294 \| \| scaffold14851_2731393_SNP | 2731393 | A | G |
| S_9347500 \| \| scaffold14851_2734484_SNP | 2734484 | G | T |
| S_9347527 \| \| scaffold14851_2734834_SNP | 2734834 | A | T |
| S_9347621 \| \| scaffold14851_2735463_SNP | 2735463 | A | T |
| S_9347622 \| \| scaffold14851_2735470_SNP | 2735470 | C | A |
| S_9347696 \| \| scaffold14851_2735664_SNP | 2735664 | G | T |
| S_9347716 \| \| scaffold14851_2735924_SNP | 2735924 | T | C |
| S_9347735 \| \| scaffold14851_2736357_SNP | 2736357 | T | A |
| S_9347750 \| \| scaffold14851_2736602_SNP | 2736602 | T | C |
| S_9347756 \| \| scaffold14851_2736703_SNP | 2736703 | C | T |
| S_9347759 \| \| scaffold14851_2736740_SNP | 2736740 | A | T |
| S_9347768 \| \| scaffold14851_2736864_SNP | 2736864 | G | C |
| S_9347772 \| \| scaffold14851_2736926_SNP | 2736926 | T | C |
| S_9347776 \| \| scaffold14851_2736941_SNP | 2736941 | A | G |
| S_9347778 \| \| scaffold14851_2736964_SNP | 2736964 | G | C |
| S_9347787 \| \| scaffold14851_2737186_SNP | 2737186 | T | A |
| S_9347831 \| \| scaffold14851_2737606_SNP | 2737606 | A | C |
| S_9347833 \| \| scaffold14851_2737615_SNP | 2737615 | G | A |
| S_9347870 \| \| scaffold14851_2738184_SNP | 2738184 | G | C |
| S_9347876 \| \| scaffold14851_2738246_SNP | 2738246 | C | T |
| S_9347896 \| \| scaffold14851_2738685_SNP | 2738685 | A | G |
| S_9347915 \| \| scaffold14851_2738913_SNP | 2738913 | A | C |
| S_9347917 \| \| scaffold14851_2738974_SNP | 2738974 | T | C |
| S_9348034 \| \| scaffold14851_2740295_SNP | 2740295 | G | A |
| S_9348035 \| \| scaffold14851_2740307_SNP | 2740307 | G | T |
| S_9348161 \| \| scaffold14851_2742211_SNP | 2742211 | A | T |
| S_9348162 \| \| scaffold14851_2742219_SNP | 2742219 | G | T |
| S_9348166 \| \| scaffold14851_2742276_SNP | 2742276 | T | A |
| S_9348167 \| \| scaffold14851_2742277_SNP | 2742277 | T | A |
| S_9348196 \| \| scaffold14851_2742755_SNP | 2742755 | G | A |
| S_9348212 \| \| scaffold14851_2743066_SNP | 2743066 | G | A |
| S_9348271 \| \| scaffold14851_2743282_SNP | 2743282 | C | A |
| S_9348311 \| \| scaffold14851_2744206_SNP | 2744206 | C | T |
| S_9348337 \| \| scaffold14851_2744312_SNP | 2744312 | A | G |
| S_9348345 \| \| scaffold14851_2744424_SNP | 2744424 | A | G |
| S_9348354 \| \| scaffold14851_2744489_SNP | 2744489 | A | C |
| S_9348364 \| \| scaffold14851_2744590_SNP | 2744590 | A | G |
| S_9348400 \| \| scaffold14851_2744837_SNP | 2744837 | C | T |
| S_9348406 \| \| scaffold14851_2744891_SNP | 2744891 | T | C |
| S_9348430 \| \| scaffold14851_2745209_SNP | 2745209 | C | T |
| S_9348468 \| \| scaffold14851_2745673_SNP | 2745673 | T | C |
| S_9348491 \| \| scaffold14851_2745960_SNP | 2745960 | T | C |
| S_9348524 \| \| scaffold14851_2746646_SNP | 2746646 | T | A |
| S_9348566 \| \| scaffold14851_2747364_SNP | 2747364 | C | A |
| S_9348764 \| \| scaffold14851_2751095_SNP | 2751095 | G | A |
| S_9348792 \| \| scaffold14851_2751681_SNP | 2751681 | T | C |
| S_9348829 \| \| scaffold14851_2752339_SNP | 2752339 | T | C |
| S_9348845 \| \| scaffold14851_2752708_SNP | 2752708 | T | C |
| S_9348878 \| \| scaffold14851_2753033_SNP | 2753033 | T | C |
| S_9348909 \| \| scaffold14851_2753369_SNP | 2753369 | G | A |
| S_9348920 \| \| scaffold14851_2753482_SNP | 2753482 | C | T |
| S_9348930 \| \| scaffold14851_2753556_SNP | 2753556 | T | C |
| S_9348938 \| \| scaffold14851_2753631_SNP | 2753631 | A | T |
| S_9348945 \| \| scaffold14851_2753651_SNP | 2753651 | C | T |
| S_9348952 \| \| scaffold14851_2753728_SNP | 2753728 | A | C |
| S_9349011 \| \| scaffold14851_2754954_SNP | 2754954 | C | G |
| S_9349015 \| \| scaffold14851_2755020_SNP | 2755020 | T | C |
| S_9349016 \| \| scaffold14851_2755031_SNP | 2755031 | T | C |
| S_9349024 \| \| scaffold14851_2755150_SNP | 2755150 | A | G |
| S_9349027 \| \| scaffold14851_2755161_SNP | 2755161 | C | T |
| S_9349047 \| \| scaffold14851_2755363_SNP | 2755363 | C | G |
| S_9349049 \| \| scaffold14851_2755370_SNP | 2755370 | C | A |
| S_9349054 \| \| scaffold14851_2755436_SNP | 2755436 | C | A |
| S_9349081 \| \| scaffold14851_2755693_SNP | 2755693 | G | T |
| S_9349083 \| \| scaffold14851_2755706_SNP | 2755706 | C | T |
| S_9349093 \| \| scaffold14851_2755758_SNP | 2755758 | G | A |
| S_9349169 \| \| scaffold14851_2757249_SNP | 2757249 | T | A |
| scaffold14851_2757435_SNP | 2757435 | A | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9349192 \|\| scaffold14851_2757477_SNP | 2757477 | T | C |
| S_9349213 \|\| scaffold14851_2757757_SNP | 2757757 | A | G |
| S_9349366 \|\| scaffold14851_2759398_SNP | 2759398 | T | C |
| S_9349375 \|\| scaffold14851_2759587_SNP | 2759587 | C | T |
| S_9349385 \|\| scaffold14851_2760011_SNP | 2760011 | G | C |
| S_9349400 \|\| scaffold14851_2760217_SNP | 2760217 | T | A |
| S_9349488 \|\| scaffold14851_2761518_SNP | 2761518 | C | T |
| S_9349526 \|\| scaffold14851_2762052_SNP | 2762052 | G | C |
| S_9349538 \|\| scaffold14851_2762163_SNP | 2762163 | G | A |
| S_9349540 \|\| scaffold14851_2762168_SNP | 2762168 | C | T |
| S_9349541 \|\| scaffold14851_2762176_SNP | 2762176 | A | C |
| S_9349558 \|\| scaffold14851_2762361_SNP | 2762361 | A | C |
| S_9349578 \|\| scaffold14851_2762672_SNP | 2762672 | C | A |
| S_9349588 \|\| scaffold14851_2762701_SNP | 2762701 | G | C |
| S_9349633 \|\| scaffold14851_2762876_SNP | 2762876 | T | C |
| S_9349651 \|\| scaffold14851_2763061_SNP | 2763061 | C | T |
| S_9349663 \|\| scaffold14851_2763304_SNP | 2763304 | T | A |
| S_9349665 \|\| scaffold14851_2763317_SNP | 2763317 | C | T |
| S_9349674 \|\| scaffold14851_2763423_SNP | 2763423 | T | C |
| S_9349691 \|\| scaffold14851_2763782_SNP | 2763782 | A | T |
| S_9349698 \|\| scaffold14851_2763882_SNP | 2763882 | G | A |
| S_9349771 \|\| scaffold14851_2764576_SNP | 2764576 | A | T |
| S_9349783 \|\| scaffold14851_2764813_SNP | 2764813 | A | C |
| S_9350121 \|\| scaffold14851_2769238_SNP | 2769238 | C | T |
| S_9350372 \|\| scaffold14851_2772534_SNP | 2772534 | G | A |
| S_9350396 \|\| scaffold14851_2772860_SNP | 2772860 | C | G |
| S_9350403 \|\| scaffold14851_2772941_SNP | 2772941 | C | A |
| S_9350423 \|\| scaffold14851_2773310_SNP | 2773310 | G | C |
| S_9350429 \|\| scaffold14851_2773402_SNP | 2773402 | C | A |
| S_9350458 \|\| scaffold14851_2773778_SNP | 2773778 | G | A |
| S_9350477 \|\| scaffold14851_2773978_SNP | 2773978 | G | T |
| S_9350479 \|\| scaffold14851_2774009_SNP | 2774009 | G | A |
| scaffold14851_2774034_SNP | 2774034 | A | C |
| S_9350485 \|\| scaffold14851_2774087_SNP | 2774087 | C | G |
| S_9350488 \|\| scaffold14851_2774142_SNP | 2774142 | C | T |
| S_9350557 \|\| scaffold14851_2775229_SNP | 2775229 | G | A |
| S_9350560 \|\| scaffold14851_2775270_SNP | 2775270 | G | A |
| S_9350562 \|\| scaffold14851_2775281_SNP | 2775281 | T | C |
| S_9350580 \|\| scaffold14851_2775625_SNP | 2775625 | T | A |
| S_9350601 \|\| scaffold14851_2776054_SNP | 2776054 | G | A |
| S_9350624 \|\| scaffold14851_2776491_SNP | 2776491 | A | G |
| S_9350693 \|\| scaffold14851_2777497_SNP | 2777497 | C | T |
| S_9350754 \|\| scaffold14851_2778059_SNP | 2778059 | A | T |
| S_9350771 \|\| scaffold14851_2778199_SNP | 2778199 | A | T |
| S_9350793 \|\| scaffold14851_2778569_SNP | 2778569 | A | G |
| S_9350794 \|\| scaffold14851_2778580_SNP | 2778580 | G | A |
| S_9350795 \|\| scaffold14851_2778586_SNP | 2778586 | T | C |
| S_9350831 \|\| scaffold14851_2779352_SNP | 2779352 | T | A |
| S_9350864 \|\| scaffold14851_2779580_SNP | 2779580 | G | T |
| S_9350936 \|\| scaffold14851_2780511_SNP | 2780511 | A | C |
| S_9350951 \|\| scaffold14851_2780693_SNP | 2780693 | T | C |
| S_9351004 \|\| scaffold14851_2781339_SNP | 2781339 | G | T |
| S_9351026 \|\| scaffold14851_2781694_SNP | 2781694 | T | G |
| S_9351045 \|\| scaffold14851_2782003_SNP | 2782003 | G | T |
| S_9351213 \|\| scaffold14851_2783850_SNP | 2783850 | T | G |
| S_9351227 \|\| scaffold14851_2784030_SNP | 2784030 | T | C |
| S_9351236 \|\| scaffold14851_2784175_SNP | 2784175 | A | G |
| S_9351238 \|\| scaffold14851_2784204_SNP | 2784204 | C | T |
| S_9351244 \|\| scaffold14851_2784365_SNP | 2784365 | A | T |
| S_9351246 \|\| scaffold14851_2784385_SNP | 2784385 | G | A |
| S_9351247 \|\| scaffold14851_2784391_SNP | 2784391 | C | T |
| S_9351251 \|\| scaffold14851_2784435_SNP | 2784435 | T | A |
| S_9351255 \|\| scaffold14851_2784530_SNP | 2784530 | T | C |
| S_9351301 \|\| scaffold14851_2784968_SNP | 2784968 | C | G |
| S_9351339 \|\| scaffold14851_2785702_SNP | 2785702 | T | A |
| S_9351370 \|\| scaffold14851_2785799_SNP | 2785799 | C | A |
| S_9351374 \|\| scaffold14851_2785894_SNP | 2785894 | G | T |
| S_9351378 \|\| scaffold14851_2785975_SNP | 2785975 | A | G |
| S_9351414 \|\| scaffold14851_2786359_SNP | 2786359 | C | T |
| S_9351419 \|\| scaffold14851_2786395_SNP | 2786395 | C | T |
| S_9351429 \|\| scaffold14851_2786528_SNP | 2786528 | G | A |
| S_9351458 \|\| scaffold14851_2786825_SNP | 2786825 | T | C |
| S_9351461 \|\| scaffold14851_2786846_SNP | 2786846 | T | C |
| S_9351497 \|\| scaffold14851_2787192_SNP | 2787192 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9351502 \|\| scaffold14851_2787227_SNP | 2787227 | A | T |
| S_9351526 \|\| scaffold14851_2787393_SNP | 2787393 | C | G |
| S_9351530 \|\| scaffold14851_2787424_SNP | 2787424 | T | C |
| S_9351636 \|\| scaffold14851_2788186_SNP | 2788186 | T | A |
| S_9351827 \|\| scaffold14851_2789196_SNP | 2789196 | T | G |
| S_9351935 \|\| scaffold14851_2790222_SNP | 2790222 | C | T |
| S_9351990 \|\| scaffold14851_2790632_SNP | 2790632 | G | A |
| S_9351993 \|\| scaffold14851_2790696_SNP | 2790696 | C | T |
| S_9352012 \|\| scaffold14851_2791137_SNP | 2791137 | A | G |
| S_9352014 \|\| scaffold14851_2791157_SNP | 2791157 | G | A |
| S_9352016 \|\| scaffold14851_2791217_SNP | 2791217 | C | T |
| S_9352039 \|\| scaffold14851_2791408_SNP | 2791408 | T | C |
| S_9352042 \|\| scaffold14851_2791437_SNP | 2791437 | C | T |
| S_9352043 \|\| scaffold14851_2791442_SNP | 2791442 | C | T |
| S_9352064 \|\| scaffold14851_2791879_SNP | 2791879 | C | T |
| S_9352107 \|\| scaffold14851_2792545_SNP | 2792545 | C | T |
| S_9352108 \|\| scaffold14851_2792548_SNP | 2792548 | C | T |
| S_9352147 \|\| scaffold14851_2793212_SNP | 2793212 | C | A |
| S_9352168 \|\| scaffold14851_2793460_SNP | 2793460 | A | G |
| S_9352187 \|\| scaffold14851_2793648_SNP | 2793648 | T | C |
| S_9352192 \|\| scaffold14851_2793701_SNP | 2793701 | A | G |
| S_9352262 \|\| scaffold14851_2794093_SNP | 2794093 | A | G |
| S_9352276 \|\| scaffold14851_2794196_SNP | 2794196 | T | C |
| S_9352279 \|\| scaffold14851_2794231_SNP | 2794231 | G | A |
| S_9352393 \|\| scaffold14851_2795631_SNP | 2795631 | G | A |
| S_9352451 \|\| scaffold14851_2796393_SNP | 2796393 | A | G |
| S_9352479 \|\| scaffold14851_2796861_SNP | 2796861 | A | T |
| S_9352480 \|\| scaffold14851_2796862_SNP | 2796862 | C | T |
| S_9352520 \|\| scaffold14851_2797268_SNP | 2797268 | C | T |
| S_9352559 \|\| scaffold14851_2797469_SNP | 2797469 | G | C |
| S_9352610 \|\| scaffold14851_2798100_SNP | 2798100 | T | G |
| S_9352644 \|\| scaffold14851_2798481_SNP | 2798481 | G | A |
| S_9352645 \|\| scaffold14851_2798482_SNP | 2798482 | G | T |
| S_9352728 \|\| scaffold14851_2799396_SNP | 2799396 | G | C |
| S_9352791 \|\| scaffold14851_2799570_SNP | 2799570 | C | T |
| S_9352854 \|\| scaffold14851_2800069_SNP | 2800069 | G | T |
| S_9352855 \|\| scaffold14851_2800100_SNP | 2800100 | T | G |
| S_9352858 \|\| scaffold14851_2800188_SNP | 2800188 | A | C |
| S_9352912 \|\| scaffold14851_2800872_SNP | 2800872 | G | C |
| S_9353254 \|\| scaffold14851_2805547_SNP | 2805547 | G | T |
| S_9353255 \|\| scaffold14851_2805549_SNP | 2805549 | A | T |
| S_9353363 \|\| scaffold14851_2806307_SNP | 2806307 | G | A |
| S_9353390 \|\| scaffold14851_2806537_SNP | 2806537 | A | T |
| S_9353407 \|\| scaffold14851_2806694_SNP | 2806694 | G | A |
| S_9353408 \|\| scaffold14851_2806695_SNP | 2806695 | G | T |
| S_9353409 \|\| scaffold14851_2806710_SNP | 2806710 | T | G |
| S_9353411 \|\| scaffold14851_2806785_SNP | 2806785 | C | T |
| S_9353412 \|\| scaffold14851_2806798_SNP | 2806798 | G | A |
| S_9353413 \|\| scaffold14851_2806801_SNP | 2806801 | C | T |
| S_9353414 \|\| scaffold14851_2806802_SNP | 2806802 | T | A |
| S_9353415 \|\| scaffold14851_2806803_SNP | 2806803 | C | T |
| S_9353416 \|\| scaffold14851_2806837_SNP | 2806837 | C | T |
| S_9353424 \|\| scaffold14851_2806943_SNP | 2806943 | C | T |
| S_9353430 \|\| scaffold14851_2807022_SNP | 2807022 | G | C |
| S_9353434 \|\| scaffold14851_2807084_SNP | 2807084 | C | G |
| S_9353438 \|\| scaffold14851_2807119_SNP | 2807119 | G | A |
| S_9353441 \|\| scaffold14851_2807186_SNP | 2807186 | A | G |
| S_9353452 \|\| scaffold14851_2807355_SNP | 2807355 | C | A |
| S_9353523 \|\| scaffold14851_2808625_SNP | 2808625 | G | T |
| S_9353587 \|\| scaffold14851_2809394_SNP | 2809394 | G | T |
| S_9353590 \|\| scaffold14851_2809469_SNP | 2809469 | T | A |
| S_9353597 \|\| scaffold14851_2809598_SNP | 2809598 | T | C |
| S_9353634 \|\| scaffold14851_2810178_SNP | 2810178 | C | G |
| S_9353647 \|\| scaffold14851_2810410_SNP | 2810410 | A | T |
| S_9353654 \|\| scaffold14851_2810463_SNP | 2810463 | T | C |
| scaffold14851_2810701_SNP | 2810701 | A | T |
| scaffold14851_2810702_SNP | 2810702 | T | G |
| S_9353667 \|\| scaffold14851_2810703_SNP | 2810703 | T | A |
| S_9353670 \|\| scaffold14851_2810818_SNP | 2810818 | G | A |
| S_9353671 \|\| scaffold14851_2810855_SNP | 2810855 | C | A |
| S_9353673 \|\| scaffold14851_2810889_SNP | 2810889 | A | G |
| S_9353686 \|\| scaffold14851_2811053_SNP | 2811053 | T | G |
| S_9353689 \|\| scaffold14851_2811091_SNP | 2811091 | G | T |
| scaffold14851_2811209_SNP | 2811209 | T | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9353727 \| \| scaffold14851_2811725_SNP | 2811725 | T | A |
| S_9353744 \| \| scaffold14851_2811954_SNP | 2811954 | A | T |
| S_9353769 \| \| scaffold14851_2812436_SNP | 2812436 | C | A |
| S_9353782 \| \| scaffold14851_2812708_SNP | 2812708 | C | A |
| scaffold14851_2812883_SNP | 2812883 | G | T |
| scaffold14851_2812888_SNP | 2812888 | A | T |
| S_9353842 \| \| scaffold14851_2813466_SNP | 2813466 | G | A |
| S_9353978 \| \| scaffold14851_2814975_SNP | 2814975 | A | T |
| S_9354090 \| \| scaffold14851_2816483_SNP | 2816483 | A | G |
| S_9354105 \| \| scaffold14851_2816599_SNP | 2816599 | C | T |
| S_9354272 \| \| scaffold14851_2818677_SNP | 2818677 | G | A |
| S_9354361 \| \| scaffold14851_2819045_SNP | 2819045 | T | C |
| S_9354372 \| \| scaffold14851_2819293_SNP | 2819293 | T | A |
| S_9354373 \| \| scaffold14851_2819308_SNP | 2819308 | A | T |
| S_9354374 \| \| scaffold14851_2819338_SNP | 2819338 | C | A |
| S_9354379 \| \| scaffold14851_2819418_SNP | 2819418 | A | C |
| S_9354380 \| \| scaffold14851_2819419_SNP | 2819419 | G | A |
| S_9354381 \| \| scaffold14851_2819420_SNP | 2819420 | G | T |
| S_9354382 \| \| scaffold14851_2819438_SNP | 2819438 | C | G |
| S_9354405 \| \| scaffold14851_2820002_SNP | 2820002 | T | G |
| S_9354422 \| \| scaffold14851_2820202_SNP | 2820202 | T | A |
| S_9354433 \| \| scaffold14851_2820339_SNP | 2820339 | G | C |
| S_9354452 \| \| scaffold14851_2820692_SNP | 2820692 | T | A |
| S_9354454 \| \| scaffold14851_2820739_SNP | 2820739 | C | A |
| S_9354459 \| \| scaffold14851_2820890_SNP | 2820890 | A | T |
| S_9354464 \| \| scaffold14851_2821029_SNP | 2821029 | G | T |
| S_9354467 \| \| scaffold14851_2821082_SNP | 2821082 | G | A |
| S_9354470 \| \| scaffold14851_2821172_SNP | 2821172 | G | T |
| S_9354472 \| \| scaffold14851_2821216_SNP | 2821216 | C | T |
| S_9354520 \| \| scaffold14851_2821756_SNP | 2821756 | G | T |
| S_9354772 \| \| scaffold14851_2824670_SNP | 2824670 | G | T |
| S_9354821 \| \| scaffold14851_2825199_SNP | 2825199 | G | A |
| S_9354972 \| \| scaffold14851_2826018_SNP | 2826018 | G | T |
| S_9354988 \| \| scaffold14851_2826375_SNP | 2826375 | G | A |
| S_9354995 \| \| scaffold14851_2826497_SNP | 2826497 | T | A |
| S_9355218 \| \| scaffold14851_2828150_SNP | 2828150 | T | A |
| S_9355224 \| \| scaffold14851_2828270_SNP | 2828270 | A | G |
| S_9355279 \| \| scaffold14851_2829288_SNP | 2829288 | A | G |
| S_9355381 \| \| scaffold14851_2830646_SNP | 2830646 | A | G |
| S_9355421 \| \| scaffold14851_2831322_SNP | 2831322 | G | T |
| S_9355458 \| \| scaffold14851_2831933_SNP | 2831933 | T | C |
| S_9355505 \| \| scaffold14851_2832888_SNP | 2832888 | T | A |
| S_9355549 \| \| scaffold14851_2833432_SNP | 2833432 | A | T |
| S_9355570 \| \| scaffold14851_2833769_SNP | 2833769 | C | A |
| S_9355607 \| \| scaffold14851_2834265_SNP | 2834265 | G | C |
| S_9355609 \| \| scaffold14851_2834352_SNP | 2834352 | C | A |
| S_9355620 \| \| scaffold14851_2834531_SNP | 2834531 | A | C |
| S_9355643 \| \| scaffold14851_2834834_SNP | 2834834 | T | C |
| S_9355698 \| \| scaffold14851_2834988_SNP | 2834988 | G | T |
| S_9355700 \| \| scaffold14851_2835122_SNP | 2835122 | A | G |
| S_9355763 \| \| scaffold14851_2835901_SNP | 2835901 | A | T |
| S_9355781 \| \| scaffold14851_2836251_SNP | 2836251 | C | T |
| S_9355961 \| \| scaffold14851_2837856_SNP | 2837856 | A | C |
| S_9355985 \| \| scaffold14851_2838348_SNP | 2838348 | G | T |
| S_9356030 \| \| scaffold14851_2839257_SNP | 2839257 | G | A |
| S_9356077 \| \| scaffold14851_2839744_SNP | 2839744 | A | C |
| S_9356105 \| \| scaffold14851_2840033_SNP | 2840033 | A | T |
| S_9356127 \| \| scaffold14851_2840198_SNP | 2840198 | C | T |
| scaffold14851_2840379_SNP | 2840379 | C | T |
| S_9356209 \| \| scaffold14851_2840939_SNP | 2840939 | A | C |
| S_9356218 \| \| scaffold14851_2841025_SNP | 2841025 | C | T |
| S_9356220 \| \| scaffold14851_2841062_SNP | 2841062 | A | G |
| S_9356224 \| \| scaffold14851_2841138_SNP | 2841138 | T | C |
| S_9356225 \| \| scaffold14851_2841147_SNP | 2841147 | G | A |
| S_9356227 \| \| scaffold14851_2841156_SNP | 2841156 | T | G |
| S_9356230 \| \| scaffold14851_2841166_SNP | 2841166 | C | T |
| S_9356249 \| \| scaffold14851_2841518_SNP | 2841518 | G | A |
| S_9356258 \| \| scaffold14851_2841622_SNP | 2841622 | G | C |
| S_9356314 \| \| scaffold14851_2842440_SNP | 2842440 | G | A |
| S_9356418 \| \| scaffold14851_2843455_SNP | 2843455 | G | A |
| S_9356421 \| \| scaffold14851_2843459_SNP | 2843459 | G | C |
| S_9356423 \| \| scaffold14851_2843477_SNP | 2843477 | G | A |
| S_9356454 \| \| scaffold14851_2844191_SNP | 2844191 | C | A |
| S_9356464 \| \| scaffold14851_2844244_SNP | 2844244 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9356480 \| \| scaffold14851_2844377_SNP | 2844377 | G | A |
| S_9356502 \| \| scaffold14851_2844517_SNP | 2844517 | T | A |
| S_9356552 \| \| scaffold14851_2845055_SNP | 2845055 | G | T |
| S_9356574 \| \| scaffold14851_2845421_SNP | 2845421 | T | G |
| S_9356615 \| \| scaffold14851_2846143_SNP | 2846143 | A | T |
| S_9356617 \| \| scaffold14851_2846152_SNP | 2846152 | A | T |
| S_9356618 \| \| scaffold14851_2846157_SNP | 2846157 | C | A |
| S_9356770 \| \| scaffold14851_2847664_SNP | 2847664 | T | C |
| S_9356831 \| \| scaffold14851_2848762_SNP | 2848762 | A | G |
| S_9356832 \| \| scaffold14851_2848783_SNP | 2848783 | G | A |
| S_9356833 \| \| scaffold14851_2848791_SNP | 2848791 | C | T |
| S_9356834 \| \| scaffold14851_2848827_SNP | 2848827 | C | T |
| S_9356859 \| \| scaffold14851_2849143_SNP | 2849143 | T | C |
| S_9356914 \| \| scaffold14851_2849343_SNP | 2849343 | T | G |
| S_9356919 \| \| scaffold14851_2849413_SNP | 2849413 | G | A |
| S_9356922 \| \| scaffold14851_2849460_SNP | 2849460 | C | A |
| S_9356925 \| \| scaffold14851_2849514_SNP | 2849514 | A | T |
| S_9356930 \| \| scaffold14851_2849585_SNP | 2849585 | G | C |
| S_9356931 \| \| scaffold14851_2849593_SNP | 2849593 | C | G |
| S_9356933 \| \| scaffold14851_2849628_SNP | 2849628 | T | G |
| S_9356936 \| \| scaffold14851_2849645_SNP | 2849645 | A | C |
| S_9356938 \| \| scaffold14851_2849834_SNP | 2849834 | G | T |
| S_9356948 \| \| scaffold14851_2850010_SNP | 2850010 | T | A |
| S_9356953 \| \| scaffold14851_2850126_SNP | 2850126 | C | G |
| S_9356964 \| \| scaffold14851_2850319_SNP | 2850319 | A | G |
| S_9357026 \| \| scaffold14851_2851226_SNP | 2851226 | A | G |
| S_9357028 \| \| scaffold14851_2851235_SNP | 2851235 | C | T |
| S_9357031 \| \| scaffold14851_2851282_SNP | 2851282 | A | G |
| S_9357032 \| \| scaffold14851_2851283_SNP | 2851283 | A | T |
| S_9357061 \| \| scaffold14851_2851783_SNP | 2851783 | T | C |
| S_9357062 \| \| scaffold14851_2851792_SNP | 2851792 | T | C |
| S_9357063 \| \| scaffold14851_2851799_SNP | 2851799 | A | T |
| S_9357078 \| \| scaffold14851_2852015_SNP | 2852015 | T | C |
| S_9357086 \| \| scaffold14851_2852342_SNP | 2852342 | A | G |
| S_9357087 \| \| scaffold14851_2852356_SNP | 2852356 | G | A |
| S_9357088 \| \| scaffold14851_2852362_SNP | 2852362 | A | T |
| S_9357090 \| \| scaffold14851_2852385_SNP | 2852385 | G | C |
| S_9357092 \| \| scaffold14851_2852443_SNP | 2852443 | A | G |
| S_9357096 \| \| scaffold14851_2852495_SNP | 2852495 | A | G |
| S_9357101 \| \| scaffold14851_2852542_SNP | 2852542 | C | T |
| S_9357105 \| \| scaffold14851_2852617_SNP | 2852617 | A | T |
| S_9357116 \| \| scaffold14851_2852719_SNP | 2852719 | C | A |
| S_9357121 \| \| scaffold14851_2852778_SNP | 2852778 | A | C |
| S_9357127 \| \| scaffold14851_2852925_SNP | 2852925 | A | T |
| S_9357145 \| \| scaffold14851_2853172_SNP | 2853172 | C | T |
| S_9357197 \| \| scaffold14851_2853867_SNP | 2853867 | T | G |
| S_9357200 \| \| scaffold14851_2853877_SNP | 2853877 | T | G |
| S_9357206 \| \| scaffold14851_2853935_SNP | 2853935 | A | T |
| S_9357251 \| \| scaffold14851_2854130_SNP | 2854130 | C | A |
| scaffold14851_2854131_SNP | 2854131 | G | A |
| S_9357278 \| \| scaffold14851_2854354_SNP | 2854354 | A | G |
| S_9357305 \| \| scaffold14851_2854856_SNP | 2854856 | T | G |
| S_9357315 \| \| scaffold14851_2855014_SNP | 2855014 | G | T |
| S_9357331 \| \| scaffold14851_2855199_SNP | 2855199 | T | C |
| S_9357361 \| \| scaffold14851_2855416_SNP | 2855416 | G | A |
| S_9357366 \| \| scaffold14851_2855429_SNP | 2855429 | C | T |
| scaffold14851_2855492_SNP | 2855492 | T | C |
| S_9357393 \| \| scaffold14851_2855567_SNP | 2855567 | T | C |
| S_9357398 \| \| scaffold14851_2855608_SNP | 2855608 | A | G |
| S_9357604 \| \| scaffold14851_2858253_SNP | 2858253 | A | G |
| S_9357788 \| \| scaffold14851_2861107_SNP | 2861107 | C | G |
| S_9357833 \| \| scaffold14851_2861676_SNP | 2861676 | G | T |
| S_9357910 \| \| scaffold14851_2862036_SNP | 2862036 | G | A |
| S_9357980 \| \| scaffold14851_2862765_SNP | 2862765 | T | A |
| S_9357981 \| \| scaffold14851_2862774_SNP | 2862774 | T | G |
| S_9358054 \| \| scaffold14851_2863367_SNP | 2863367 | G | A |
| S_9358055 \| \| scaffold14851_2863409_SNP | 2863409 | T | C |
| S_9358064 \| \| scaffold14851_2863571_SNP | 2863571 | C | A |
| S_9358092 \| \| scaffold14851_2863924_SNP | 2863924 | C | T |
| S_9358128 \| \| scaffold14851_2864259_SNP | 2864259 | T | C |
| S_9358177 \| \| scaffold14851_2865015_SNP | 2865015 | G | A |
| S_9358239 \| \| scaffold14851_2865671_SNP | 2865671 | T | G |
| S_9358315 \| \| scaffold14851_2866139_SNP | 2866139 | G | A |
| S_9358354 \| \| scaffold14851_2866812_SNP | 2866812 | A | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9358357 \| \| scaffold14851_2866901_SNP | 2866901 | C | A |
| S_9358360 \| \| scaffold14851_2866923_SNP | 2866923 | A | G |
| S_9358371 \| \| scaffold14851_2867306_SNP | 2867306 | C | T |
| S_9358475 \| \| scaffold14851_2868175_SNP | 2868175 | A | G |
| S_9358476 \| \| scaffold14851_2868183_SNP | 2868183 | A | T |
| S_9358477 \| \| scaffold14851_2868204_SNP | 2868204 | T | C |
| S_9358483 \| \| scaffold14851_2868356_SNP | 2868356 | G | A |
| S_9358485 \| \| scaffold14851_2868373_SNP | 2868373 | A | G |
| S_9358486 \| \| scaffold14851_2868408_SNP | 2868408 | G | A |
| S_9358488 \| \| scaffold14851_2868437_SNP | 2868437 | A | G |
| S_9358491 \| \| scaffold14851_2868450_SNP | 2868450 | T | C |
| S_9358493 \| \| scaffold14851_2868492_SNP | 2868492 | T | C |
| S_9358494 \| \| scaffold14851_2868528_SNP | 2868528 | A | G |
| S_9358497 \| \| scaffold14851_2868608_SNP | 2868608 | A | G |
| S_9358498 \| \| scaffold14851_2868637_SNP | 2868637 | G | A |
| S_9358520 \| \| scaffold14851_2869019_SNP | 2869019 | G | T |
| S_9358521 \| \| scaffold14851_2869047_SNP | 2869047 | C | T |
| S_9358525 \| \| scaffold14851_2869137_SNP | 2869137 | A | T |
| S_9358528 \| \| scaffold14851_2869159_SNP | 2869159 | A | G |
| S_9358530 \| \| scaffold14851_2869196_SNP | 2869196 | G | A |
| S_9358531 \| \| scaffold14851_2869206_SNP | 2869206 | C | T |
| S_9358533 \| \| scaffold14851_2869219_SNP | 2869219 | A | G |
| S_9358535 \| \| scaffold14851_2869317_SNP | 2869317 | A | G |
| S_9358559 \| \| scaffold14851_2869700_SNP | 2869700 | T | G |
| S_9358675 \| \| scaffold14851_2871091_SNP | 2871091 | A | C |
| S_9358685 \| \| scaffold14851_2871291_SNP | 2871291 | T | G |
| S_9358700 \| \| scaffold14851_2871537_SNP | 2871537 | C | G |
| S_9358865 \| \| scaffold14851_2873332_SNP | 2873332 | G | C |
| S_9358878 \| \| scaffold14851_2873593_SNP | 2873593 | C | G |
| S_9358899 \| \| scaffold14851_2873848_SNP | 2873848 | A | G |
| S_9358989 \| \| scaffold14851_2875168_SNP | 2875168 | T | A |
| S_9358996 \| \| scaffold14851_2875301_SNP | 2875301 | C | T |
| S_9359033 \| \| scaffold14851_2876107_SNP | 2876107 | T | A |
| S_9359098 \| \| scaffold14851_2877168_SNP | 2877168 | A | C |
| S_9359105 \| \| scaffold14851_2877261_SNP | 2877261 | C | T |
| S_9359315 \| \| scaffold14851_2880193_SNP | 2880193 | A | G |
| S_9359374 \| \| scaffold14851_2880871_SNP | 2880871 | C | A |
| S_9359378 \| \| scaffold14851_2880897_SNP | 2880897 | T | G |
| scaffold14851_2881268_SNP | 2881268 | T | C |
| S_9359425 \| \| scaffold14851_2881570_SNP | 2881570 | C | T |
| S_9359429 \| \| scaffold14851_2881615_SNP | 2881615 | G | T |
| S_9359442 \| \| scaffold14851_2881888_SNP | 2881888 | A | T |
| S_9359507 \| \| scaffold14851_2882608_SNP | 2882608 | T | C |
| S_9359527 \| \| scaffold14851_2882889_SNP | 2882889 | C | T |
| S_9359555 \| \| scaffold14851_2883387_SNP | 2883387 | G | C |
| S_9359669 \| \| scaffold14851_2884502_SNP | 2884502 | A | T |
| S_9359718 \| \| scaffold14851_2885198_SNP | 2885198 | C | A |
| S_9359722 \| \| scaffold14851_2885264_SNP | 2885264 | G | A |
| S_9359740 \| \| scaffold14851_2885472_SNP | 2885472 | G | A |
| S_9360158 \| \| scaffold14851_2888765_SNP | 2888765 | A | C |
| S_9360172 \| \| scaffold14851_2888902_SNP | 2888902 | C | G |
| S_9360248 \| \| scaffold14851_2890301_SNP | 2890301 | G | T |
| S_9360257 \| \| scaffold14851_2890523_SNP | 2890523 | C | A |
| S_9360282 \| \| scaffold14851_2890986_SNP | 2890986 | G | A |
| S_9360285 \| \| scaffold14851_2891029_SNP | 2891029 | G | A |
| S_9360296 \| \| scaffold14851_2891215_SNP | 2891215 | A | G |
| S_9360297 \| \| scaffold14851_2891226_SNP | 2891226 | T | G |
| S_9360299 \| \| scaffold14851_2891336_SNP | 2891336 | T | C |
| S_9360300 \| \| scaffold14851_2891344_SNP | 2891344 | T | A |
| S_9360502 \| \| scaffold14851_2893938_SNP | 2893938 | G | T |
| S_9360510 \| \| scaffold14851_2894062_SNP | 2894062 | A | G |
| S_9360557 \| \| scaffold14851_2894880_SNP | 2894880 | C | A |
| S_9360560 \| \| scaffold14851_2894930_SNP | 2894930 | G | C |
| S_9360564 \| \| scaffold14851_2895051_SNP | 2895051 | C | T |
| S_9360591 \| \| scaffold14851_2895493_SNP | 2895493 | T | C |
| S_9360592 \| \| scaffold14851_2895502_SNP | 2895502 | G | T |
| S_9360593 \| \| scaffold14851_2895513_SNP | 2895513 | T | C |
| S_9360609 \| \| scaffold14851_2895782_SNP | 2895782 | C | G |
| S_9360614 \| \| scaffold14851_2895878_SNP | 2895878 | C | T |
| S_9360670 \| \| scaffold14851_2896298_SNP | 2896298 | A | G |
| S_9360680 \| \| scaffold14851_2896518_SNP | 2896518 | C | T |
| S_9360685 \| \| scaffold14851_2896578_SNP | 2896578 | A | C |
| S_9360692 \| \| scaffold14851_2896724_SNP | 2896724 | A | G |
| S_9360693 \| \| scaffold14851_2896739_SNP | 2896739 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9360695 \| \| scaffold14851_2896774_SNP | 2896774 | A | G |
| S_9360696 \| \| scaffold14851_2896805_SNP | 2896805 | A | C |
| S_9360728 \| \| scaffold14851_2897183_SNP | 2897183 | G | A |
| S_9360729 \| \| scaffold14851_2897207_SNP | 2897207 | G | A |
| S_9360778 \| \| scaffold14851_2898010_SNP | 2898010 | G | A |
| S_9360791 \| \| scaffold14851_2898155_SNP | 2898155 | T | G |
| S_9360830 \| \| scaffold14851_2898747_SNP | 2898747 | G | T |
| S_9360847 \| \| scaffold14851_2899123_SNP | 2899123 | T | A |
| S_9360851 \| \| scaffold14851_2899169_SNP | 2899169 | A | G |
| S_9360971 \| \| scaffold14851_2901136_SNP | 2901136 | C | A |
| S_9361012 \| \| scaffold14851_2901790_SNP | 2901790 | G | A |
| S_9361036 \| \| scaffold14851_2901852_SNP | 2901852 | C | T |
| S_9361053 \| \| scaffold14851_2902192_SNP | 2902192 | T | C |
| S_9361144 \| \| scaffold14851_2903501_SNP | 2903501 | T | C |
| S_9361259 \| \| scaffold14851_2904869_SNP | 2904869 | T | A |
| S_9361272 \| \| scaffold14851_2904925_SNP | 2904925 | A | T |
| S_9361278 \| \| scaffold14851_2904942_SNP | 2904942 | G | A |
| S_9361313 \| \| scaffold14851_2905088_SNP | 2905088 | C | T |
| S_9361335 \| \| scaffold14851_2905446_SNP | 2905446 | G | A |
| S_9361338 \| \| scaffold14851_2905457_SNP | 2905457 | T | C |
| S_9361339 \| \| scaffold14851_2905478_SNP | 2905478 | C | A |
| S_9361347 \| \| scaffold14851_2905565_SNP | 2905565 | T | C |
| S_9361361 \| \| scaffold14851_2905788_SNP | 2905788 | A | C |
| S_9361436 \| \| scaffold14851_2907176_SNP | 2907176 | C | T |
| S_9361582 \| \| scaffold14851_2912143_SNP | 2912143 | T | C |
| S_9361603 \| \| scaffold14851_2912333_SNP | 2912333 | A | T |
| S_9361620 \| \| scaffold14851_2912487_SNP | 2912487 | G | A |
| S_9361637 \| \| scaffold14851_2912616_SNP | 2912616 | A | G |
| S_9361646 \| \| scaffold14851_2912667_SNP | 2912667 | T | C |
| S_9361865 \| \| scaffold14851_2915538_SNP | 2915538 | T | G |
| S_9361880 \| \| scaffold14851_2915801_SNP | 2915801 | A | G |
| S_9361881 \| \| scaffold14851_2915802_SNP | 2915802 | C | T |
| S_9362103 \| \| scaffold14851_2918292_SNP | 2918292 | C | T |
| S_9362169 \| \| scaffold14851_2919300_SNP | 2919300 | A | C |
| S_9362209 \| \| scaffold14851_2920105_SNP | 2920105 | C | T |
| S_9362268 \| \| scaffold14851_2921151_SNP | 2921151 | G | C |
| S_9362386 \| \| scaffold14851_2922760_SNP | 2922760 | T | A |
| S_9362390 \| \| scaffold14851_2922778_SNP | 2922778 | T | G |
| S_9362414 \| \| scaffold14851_2923164_SNP | 2923164 | G | A |
| S_9362427 \| \| scaffold14851_2923462_SNP | 2923462 | G | A |
| S_9362445 \| \| scaffold14851_2923832_SNP | 2923832 | C | T |
| S_9362460 \| \| scaffold14851_2924097_SNP | 2924097 | C | T |
| S_9362461 \| \| scaffold14851_2924102_SNP | 2924102 | C | T |
| S_9362483 \| \| scaffold14851_2924506_SNP | 2924506 | G | T |
| S_9362488 \| \| scaffold14851_2924637_SNP | 2924637 | G | C |
| S_9362490 \| \| scaffold14851_2924666_SNP | 2924666 | G | A |
| S_9362502 \| \| scaffold14851_2924840_SNP | 2924840 | G | C |
| S_9362504 \| \| scaffold14851_2924874_SNP | 2924874 | C | T |
| S_9362505 \| \| scaffold14851_2924881_SNP | 2924881 | C | T |
| S_9362571 \| \| scaffold14851_2925343_SNP | 2925343 | A | T |
| S_9362578 \| \| scaffold14851_2925400_SNP | 2925400 | C | T |
| S_9362587 \| \| scaffold14851_2925569_SNP | 2925569 | T | C |
| S_9362604 \| \| scaffold14851_2925677_SNP | 2925677 | T | A |
| S_9362632 \| \| scaffold14851_2926356_SNP | 2926356 | G | T |
| S_9362633 \| \| scaffold14851_2926386_SNP | 2926386 | A | G |
| S_9362652 \| \| scaffold14851_2926667_SNP | 2926667 | A | G |
| S_9362664 \| \| scaffold14851_2926877_SNP | 2926877 | A | G |
| S_9362666 \| \| scaffold14851_2927047_SNP | 2927047 | C | A |
| S_9362677 \| \| scaffold14851_2927142_SNP | 2927142 | A | G |
| S_9362703 \| \| scaffold14851_2927417_SNP | 2927417 | G | T |
| S_9362710 \| \| scaffold14851_2927579_SNP | 2927579 | C | T |
| S_9362711 \| \| scaffold14851_2927580_SNP | 2927580 | A | G |
| S_9362718 \| \| scaffold14851_2927652_SNP | 2927652 | T | C |
| S_9362728 \| \| scaffold14851_2927868_SNP | 2927868 | C | T |
| S_9362765 \| \| scaffold14851_2928348_SNP | 2928348 | C | G |
| S_9362788 \| \| scaffold14851_2928703_SNP | 2928703 | T | C |
| S_9362801 \| \| scaffold14851_2928949_SNP | 2928949 | G | A |
| S_9362830 \| \| scaffold14851_2929364_SNP | 2929364 | A | C |
| S_9362935 \| \| scaffold14851_2930843_SNP | 2930843 | A | G |
| S_9362957 \| \| scaffold14851_2931265_SNP | 2931265 | A | C |
| S_9362964 \| \| scaffold14851_2931433_SNP | 2931433 | C | A |
| S_9362974 \| \| scaffold14851_2931555_SNP | 2931555 | A | T |
| S_9362975 \| \| scaffold14851_2931569_SNP | 2931569 | A | T |
| S_9362980 \| \| scaffold14851_2931654_SNP | 2931654 | C | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9362981 \| \| scaffold14851_2931694_SNP | 2931694 | G | A |
| S_9362982 \| \| scaffold14851_2931699_SNP | 2931699 | T | C |
| S_9362983 \| \| scaffold14851_2931707_SNP | 2931707 | G | C |
| S_9363005 \| \| scaffold14851_2932118_SNP | 2932118 | A | G |
| S_9363087 \| \| scaffold14851_2933256_SNP | 2933256 | A | G |
| S_9363140 \| \| scaffold14851_2934092_SNP | 2934092 | G | T |
| S_9363215 \| \| scaffold14851_2934986_SNP | 2934986 | T | A |
| S_9363230 \| \| scaffold14851_2935093_SNP | 2935093 | A | G |
| S_9363241 \| \| scaffold14851_2935127_SNP | 2935127 | G | T |
| S_9363368 \| \| scaffold14851_2936934_SNP | 2936934 | C | T |
| S_9363373 \| \| scaffold14851_2936950_SNP | 2936950 | T | C |
| S_9363376 \| \| scaffold14851_2937041_SNP | 2937041 | G | A |
| S_9363388 \| \| scaffold14851_2937139_SNP | 2937139 | T | C |
| S_9363392 \| \| scaffold14851_2937209_SNP | 2937209 | A | G |
| S_9363405 \| \| scaffold14851_2937373_SNP | 2937373 | T | C |
| S_9363409 \| \| scaffold14851_2937391_SNP | 2937391 | G | A |
| S_9363457 \| \| scaffold14851_2937864_SNP | 2937864 | T | C |
| S_9363535 \| \| scaffold14851_2939495_SNP | 2939495 | A | T |
| S_9363552 \| \| scaffold14851_2939875_SNP | 2939875 | C | A |
| S_9363559 \| \| scaffold14851_2940019_SNP | 2940019 | A | C |
| S_9363574 \| \| scaffold14851_2940363_SNP | 2940363 | C | A |
| S_9363699 \| \| scaffold14851_2941602_SNP | 2941602 | C | T |
| S_9363878 \| \| scaffold14851_2944910_SNP | 2944910 | G | T |
| S_9363923 \| \| scaffold14851_2945793_SNP | 2945793 | G | A |
| S_9363930 \| \| scaffold14851_2945849_SNP | 2945849 | A | C |
| S_9363957 \| \| scaffold14851_2946222_SNP | 2946222 | G | T |
| S_9364029 \| \| scaffold14851_2946806_SNP | 2946806 | G | A |
| S_9364033 \| \| scaffold14851_2946851_SNP | 2946851 | C | G |
| S_9364213 \| \| scaffold14851_2948844_SNP | 2948844 | T | A |
| S_9364215 \| \| scaffold14851_2948845_SNP | 2948845 | C | A |
| S_9364276 \| \| scaffold14851_2949559_SNP | 2949559 | T | G |
| S_9364302 \| \| scaffold14851_2949917_SNP | 2949917 | A | T |
| S_9364454 \| \| scaffold14851_2951185_SNP | 2951185 | A | C |
| S_9364459 \| \| scaffold14851_2951256_SNP | 2951256 | G | A |
| S_9364462 \| \| scaffold14851_2951271_SNP | 2951271 | A | T |
| S_9364496 \| \| scaffold14851_2951888_SNP | 2951888 | C | T |
| S_9364497 \| \| scaffold14851_2951894_SNP | 2951894 | A | T |
| S_9364510 \| \| scaffold14851_2951990_SNP | 2951990 | T | G |
| S_9364528 \| \| scaffold14851_2952118_SNP | 2952118 | C | G |
| S_9364538 \| \| scaffold14851_2952208_SNP | 2952208 | C | T |
| S_9364559 \| \| scaffold14851_2952393_SNP | 2952393 | A | C |
| S_9364573 \| \| scaffold14851_2952569_SNP | 2952569 | G | A |
| S_9364633 \| \| scaffold14851_2953413_SNP | 2953413 | A | C |
| S_9364644 \| \| scaffold14851_2953586_SNP | 2953586 | T | C |
| S_9364678 \| \| scaffold14851_2953955_SNP | 2953955 | C | T |
| scaffold14851_2954447_SNP | 2954447 | G | T |
| S_9364852 \| \| scaffold14851_2955280_SNP | 2955280 | C | T |
| S_9364988 \| \| scaffold14851_2956341_SNP | 2956341 | T | G |
| S_9364996 \| \| scaffold14851_2956441_SNP | 2956441 | A | G |
| S_9365079 \| \| scaffold14851_2957364_SNP | 2957364 | G | C |
| S_9365110 \| \| scaffold14851_2957651_SNP | 2957651 | T | C |
| S_9365242 \| \| scaffold14851_2959605_SNP | 2959605 | C | T |
| S_9365245 \| \| scaffold14851_2959660_SNP | 2959660 | A | G |
| S_9365256 \| \| scaffold14851_2959828_SNP | 2959828 | T | C |
| S_9365262 \| \| scaffold14851_2959882_SNP | 2959882 | A | T |
| S_9365268 \| \| scaffold14851_2960030_SNP | 2960030 | G | A |
| S_9365269 \| \| scaffold14851_2960035_SNP | 2960035 | G | A |
| S_9365385 \| \| scaffold14851_2962585_SNP | 2962585 | C | T |
| S_9365393 \| \| scaffold14851_2962849_SNP | 2962849 | C | A |
| S_9365416 \| \| scaffold14851_2963215_SNP | 2963215 | T | G |
| S_9365418 \| \| scaffold14851_2963234_SNP | 2963234 | T | G |
| S_9365448 \| \| scaffold14851_2963601_SNP | 2963601 | G | A |
| S_9365463 \| \| scaffold14851_2963772_SNP | 2963772 | C | T |
| S_9365574 \| \| scaffold14851_2965356_SNP | 2965356 | A | G |
| scaffold14851_2965623_SNP | 2965623 | A | G |
| S_9365848 \| \| scaffold14851_2967857_SNP | 2967857 | A | C |
| S_9365853 \| \| scaffold14851_2968158_SNP | 2968158 | A | G |
| S_9365877 \| \| scaffold14851_2968507_SNP | 2968507 | G | T |
| S_9365878 \| \| scaffold14851_2968516_SNP | 2968516 | G | C |
| S_9365887 \| \| scaffold14851_2968676_SNP | 2968676 | A | G |
| S_9365890 \| \| scaffold14851_2968862_SNP | 2968862 | A | G |
| S_9365892 \| \| scaffold14851_2968866_SNP | 2968866 | C | T |
| S_9365967 \| \| scaffold14851_2969812_SNP | 2969812 | T | C |
| S_9366054 \| \| scaffold14851_2970773_SNP | 2970773 | T | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9366108 \| \| scaffold14851_2971276_SNP | 2971276 | G | A |
| S_9366184 \| \| scaffold14851_2971616_SNP | 2971616 | C | G |
| S_9366200 \| \| scaffold14851_2971910_SNP | 2971910 | T | G |
| S_9366201 \| \| scaffold14851_2971922_SNP | 2971922 | T | A |
| S_9366205 \| \| scaffold14851_2971970_SNP | 2971970 | T | G |
| S_9366241 \| \| scaffold14851_2972510_SNP | 2972510 | T | G |
| S_9366246 \| \| scaffold14851_2972586_SNP | 2972586 | C | T |
| S_9366265 \| \| scaffold14851_2972784_SNP | 2972784 | T | C |
| S_9366303 \| \| scaffold14851_2973254_SNP | 2973254 | G | A |
| S_9366392 \| \| scaffold14851_2973837_SNP | 2973837 | G | T |
| S_9366557 \| \| scaffold14851_2976268_SNP | 2976268 | T | C |
| S_9366568 \| \| scaffold14851_2976482_SNP | 2976482 | G | A |
| S_9366588 \| \| scaffold14851_2976751_SNP | 2976751 | C | A |
| S_9366608 \| \| scaffold14851_2976995_SNP | 2976995 | A | G |
| S_9366694 \| \| scaffold14851_2977963_SNP | 2977963 | C | A |
| S_9366696 \| \| scaffold14851_2977971_SNP | 2977971 | T | A |
| S_9366697 \| \| scaffold14851_2977976_SNP | 2977976 | A | T |
| S_9366744 \| \| scaffold14851_2978407_SNP | 2978407 | A | G |
| S_9366802 \| \| scaffold14851_2979208_SNP | 2979208 | G | A |
| S_9366804 \| \| scaffold14851_2979228_SNP | 2979228 | C | T |
| S_9366805 \| \| scaffold14851_2979229_SNP | 2979229 | G | C |
| S_9366806 \| \| scaffold14851_2979230_SNP | 2979230 | G | A |
| S_9366810 \| \| scaffold14851_2979312_SNP | 2979312 | A | G |
| S_9366812 \| \| scaffold14851_2979353_SNP | 2979353 | A | C |
| S_9366817 \| \| scaffold14851_2979416_SNP | 2979416 | G | T |
| S_9366818 \| \| scaffold14851_2979438_SNP | 2979438 | T | C |
| S_9366931 \| \| scaffold14851_2981169_SNP | 2981169 | A | C |
| S_9366934 \| \| scaffold14851_2981220_SNP | 2981220 | C | T |
| S_9366955 \| \| scaffold14851_2981420_SNP | 2981420 | C | A |
| S_9366967 \| \| scaffold14851_2981613_SNP | 2981613 | T | C |
| S_9366968 \| \| scaffold14851_2981631_SNP | 2981631 | A | C |
| S_9366971 \| \| scaffold14851_2981641_SNP | 2981641 | T | C |
| S_9367000 \| \| scaffold14851_2981988_SNP | 2981988 | A | G |
| S_9367068 \| \| scaffold14851_2983249_SNP | 2983249 | A | T |
| S_9367072 \| \| scaffold14851_2983266_SNP | 2983266 | T | C |
| S_9367075 \| \| scaffold14851_2983301_SNP | 2983301 | A | G |
| S_9367105 \| \| scaffold14851_2983791_SNP | 2983791 | G | A |
| S_9367151 \| \| scaffold14851_2984626_SNP | 2984626 | A | T |
| S_9367179 \| \| scaffold14851_2984866_SNP | 2984866 | G | A |
| S_9367181 \| \| scaffold14851_2984973_SNP | 2984973 | T | A |
| S_9367194 \| \| scaffold14851_2985385_SNP | 2985385 | T | G |
| S_9367264 \| \| scaffold14851_2985603_SNP | 2985603 | C | T |
| S_9367284 \| \| scaffold14851_2985882_SNP | 2985882 | G | T |
| S_9367290 \| \| scaffold14851_2986013_SNP | 2986013 | C | A |
| S_9367327 \| \| scaffold14851_2986640_SNP | 2986640 | G | A |
| S_9367328 \| \| scaffold14851_2986661_SNP | 2986661 | C | T |
| S_9367337 \| \| scaffold14851_2986762_SNP | 2986762 | A | C |
| S_9367339 \| \| scaffold14851_2986764_SNP | 2986764 | T | G |
| S_9367340 \| \| scaffold14851_2986809_SNP | 2986809 | G | C |
| S_9367346 \| \| scaffold14851_2986920_SNP | 2986920 | A | C |
| S_9367352 \| \| scaffold14851_2987038_SNP | 2987038 | T | C |
| S_9367375 \| \| scaffold14851_2987744_SNP | 2987744 | T | A |
| S_9367378 \| \| scaffold14851_2987746_SNP | 2987746 | T | G |
| S_9367476 \| \| scaffold14851_2989190_SNP | 2989190 | C | T |
| S_9367477 \| \| scaffold14851_2989206_SNP | 2989206 | T | C |
| S_9367478 \| \| scaffold14851_2989209_SNP | 2989209 | T | C |
| S_9367485 \| \| scaffold14851_2989306_SNP | 2989306 | G | C |
| S_9367500 \| \| scaffold14851_2989464_SNP | 2989464 | C | A |
| S_9367525 \| \| scaffold14851_2989632_SNP | 2989632 | C | T |
| S_9367533 \| \| scaffold14851_2989734_SNP | 2989734 | T | C |
| S_9367549 \| \| scaffold14851_2990122_SNP | 2990122 | A | G |
| S_9367562 \| \| scaffold14851_2990225_SNP | 2990225 | C | T |
| S_9367611 \| \| scaffold14851_2991127_SNP | 2991127 | A | G |
| S_9367627 \| \| scaffold14851_2991393_SNP | 2991393 | C | T |
| S_9367641 \| \| scaffold14851_2991573_SNP | 2991573 | G | A |
| S_9367713 \| \| scaffold14851_2992292_SNP | 2992292 | C | T |
| S_9367724 \| \| scaffold14851_2992502_SNP | 2992502 | G | C |
| S_9367814 \| \| scaffold14851_2994046_SNP | 2994046 | G | T |
| S_9367828 \| \| scaffold14851_2994241_SNP | 2994241 | G | T |
| S_9367844 \| \| scaffold14851_2994413_SNP | 2994413 | A | G |
| S_9367871 \| \| scaffold14851_2994926_SNP | 2994926 | C | T |
| S_9367947 \| \| scaffold14851_2995750_SNP | 2995750 | A | T |
| scaffold14851_2996299_SNP | 2996299 | C | T |
| S_9368075 \| \| scaffold14851_2996310_SNP | 2996310 | C | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| scaffold14851_2996397_SNP | 2996397 | A | G |
| S_9368154 \| \| scaffold14851_2996494_SNP | 2996494 | C | T |
| S_9368159 \| \| scaffold14851_2996521_SNP | 2996521 | A | G |
| S_9368354 \| \| scaffold14851_2997819_SNP | 2997819 | G | A |
| S_9368375 \| \| scaffold14851_2998085_SNP | 2998085 | G | T |
| S_9368383 \| \| scaffold14851_2998219_SNP | 2998219 | T | C |
| S_9368469 \| \| scaffold14851_2999590_SNP | 2999590 | T | C |
| S_9368470 \| \| scaffold14851_2999603_SNP | 2999603 | A | G |
| S_9368482 \| \| scaffold14851_2999754_SNP | 2999754 | G | C |
| S_9368502 \| \| scaffold14851_2999938_SNP | 2999938 | A | C |
| S_9368503 \| \| scaffold14851_2999990_SNP | 2999990 | C | A |
| S_9368514 \| \| scaffold14851_3000216_SNP | 3000216 | C | T |
| S_9368524 \| \| scaffold14851_3000463_SNP | 3000463 | T | C |
| S_9368544 \| \| scaffold14851_3000811_SNP | 3000811 | G | C |
| S_9368545 \| \| scaffold14851_3000890_SNP | 3000890 | A | C |
| S_9368546 \| \| scaffold14851_3000891_SNP | 3000891 | T | A |
| S_9368608 \| \| scaffold14851_3001357_SNP | 3001357 | T | C |
| S_9368610 \| \| scaffold14851_3001378_SNP | 3001378 | A | G |
| S_9368627 \| \| scaffold14851_3001649_SNP | 3001649 | G | A |
| S_9368644 \| \| scaffold14851_3001974_SNP | 3001974 | C | A |
| S_9368658 \| \| scaffold14851_3002200_SNP | 3002200 | G | C |
| S_9368680 \| \| scaffold14851_3002488_SNP | 3002488 | C | T |
| S_9368702 \| \| scaffold14851_3002661_SNP | 3002661 | G | C |
| S_9368743 \| \| scaffold14851_3003359_SNP | 3003359 | T | C |
| S_9368765 \| \| scaffold14851_3003679_SNP | 3003679 | C | T |
| S_9368782 \| \| scaffold14851_3003885_SNP | 3003885 | C | T |
| S_9368784 \| \| scaffold14851_3003930_SNP | 3003930 | T | G |
| S_9368785 \| \| scaffold14851_3003958_SNP | 3003958 | C | T |
| S_9368792 \| \| scaffold14851_3003988_SNP | 3003988 | A | T |
| S_9368831 \| \| scaffold14851_3004596_SNP | 3004596 | C | T |
| S_9369045 \| \| scaffold14851_3006890_SNP | 3006890 | C | T |
| S_9369245 \| \| scaffold14851_3008833_SNP | 3008833 | A | T |
| S_9369360 \| \| scaffold14851_3009898_SNP | 3009898 | A | G |
| S_9369363 \| \| scaffold14851_3010005_SNP | 3010005 | T | C |
| S_9369411 \| \| scaffold14851_3010776_SNP | 3010776 | G | A |
| S_9369419 \| \| scaffold14851_3011067_SNP | 3011067 | G | A |
| S_9369586 \| \| scaffold14851_3013303_SNP | 3013303 | G | A |
| S_9369588 \| \| scaffold14851_3013340_SNP | 3013340 | G | T |
| S_9369592 \| \| scaffold14851_3013380_SNP | 3013380 | T | A |
| S_9369650 \| \| scaffold14851_3014297_SNP | 3014297 | T | A |
| S_9370265 \| \| scaffold14851_3026390_SNP | 3026390 | G | T |
| S_9370442 \| \| scaffold14851_3029582_SNP | 3029582 | C | T |
| S_9370494 \| \| scaffold14851_3030318_SNP | 3030318 | A | G |
| S_9370576 \| \| scaffold14851_3031716_SNP | 3031716 | A | C |
| S_9370589 \| \| scaffold14851_3031928_SNP | 3031928 | C | T |
| S_9370592 \| \| scaffold14851_3032005_SNP | 3032005 | G | C |
| S_9370625 \| \| scaffold14851_3032407_SNP | 3032407 | C | G |
| S_9370706 \| \| scaffold14851_3033532_SNP | 3033532 | A | G |
| S_9370727 \| \| scaffold14851_3033910_SNP | 3033910 | T | A |
| S_9370753 \| \| scaffold14851_3034434_SNP | 3034434 | A | G |
| S_9371103 \| \| scaffold14851_3037831_SNP | 3037831 | T | A |
| S_9371105 \| \| scaffold14851_3037848_SNP | 3037848 | A | C |
| S_9371257 \| \| scaffold14851_3039054_SNP | 3039054 | A | C |
| S_9371262 \| \| scaffold14851_3039180_SNP | 3039180 | T | C |
| S_9371388 \| \| scaffold14851_3040936_SNP | 3040936 | T | A |
| S_9371390 \| \| scaffold14851_3040950_SNP | 3040950 | A | T |
| S_9371394 \| \| scaffold14851_3041008_SNP | 3041008 | G | C |
| S_9371417 \| \| scaffold14851_3041295_SNP | 3041295 | G | A |
| S_9371587 \| \| scaffold14851_3043138_SNP | 3043138 | T | C |
| S_9371616 \| \| scaffold14851_3043753_SNP | 3043753 | G | T |
| S_9371639 \| \| scaffold14851_3043889_SNP | 3043889 | C | T |
| S_9371645 \| \| scaffold14851_3043973_SNP | 3043973 | A | G |
| S_9371998 \| \| scaffold14851_3047386_SNP | 3047386 | G | C |
| S_9372021 \| \| scaffold14851_3047696_SNP | 3047696 | A | T |
| S_9372052 \| \| scaffold14851_3048106_SNP | 3048106 | A | C |
| S_9372058 \| \| scaffold14851_3048151_SNP | 3048151 | C | T |
| S_9372115 \| \| scaffold14851_3048432_SNP | 3048432 | C | A |
| S_9372137 \| \| scaffold14851_3048870_SNP | 3048870 | A | C |
| S_9372261 \| \| scaffold14851_3049750_SNP | 3049750 | C | G |
| S_9372265 \| \| scaffold14851_3049787_SNP | 3049787 | A | G |
| S_9372277 \| \| scaffold14851_3049907_SNP | 3049907 | T | A |
| S_9372282 \| \| scaffold14851_3049996_SNP | 3049996 | G | A |
| S_9372318 \| \| scaffold14851_3050373_SNP | 3050373 | A | C |
| S_9372328 \| \| scaffold14851_3050537_SNP | 3050537 | C | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9372338 \| \| scaffold14851_3050662_SNP | 3050662 | C | G |
| S_9372363 \| \| scaffold14851_3050962_SNP | 3050962 | G | T |
| S_9372381 \| \| scaffold14851_3051218_SNP | 3051218 | A | T |
| S_9372425 \| \| scaffold14851_3051779_SNP | 3051779 | T | A |
| S_9372480 \| \| scaffold14851_3052082_SNP | 3052082 | A | G |
| S_9372696 \| \| scaffold14851_3054983_SNP | 3054983 | C | T |
| S_9372740 \| \| scaffold14851_3055571_SNP | 3055571 | C | G |
| S_9372753 \| \| scaffold14851_3055717_SNP | 3055717 | C | G |
| S_9372755 \| \| scaffold14851_3055741_SNP | 3055741 | C | T |
| S_9372756 \| \| scaffold14851_3055768_SNP | 3055768 | T | G |
| S_9372757 \| \| scaffold14851_3055786_SNP | 3055786 | C | T |
| S_9372763 \| \| scaffold14851_3055881_SNP | 3055881 | G | C |
| S_9372766 \| \| scaffold14851_3055899_SNP | 3055899 | C | G |
| S_9372779 \| \| scaffold14851_3056011_SNP | 3056011 | C | T |
| S_9372780 \| \| scaffold14851_3056023_SNP | 3056023 | C | T |
| S_9372781 \| \| scaffold14851_3056029_SNP | 3056029 | G | A |
| S_9373084 \| \| scaffold14851_3058844_SNP | 3058844 | C | A |
| S_9373085 \| \| scaffold14851_3058845_SNP | 3058845 | G | C |
| S_9373092 \| \| scaffold14851_3058911_SNP | 3058911 | A | G |
| S_9373176 \| \| scaffold14851_3059947_SNP | 3059947 | G | A |
| S_9373206 \| \| scaffold14851_3060526_SNP | 3060526 | C | T |
| S_9373260 \| \| scaffold14851_3061425_SNP | 3061425 | G | T |
| S_9373416 \| \| scaffold14851_3063573_SNP | 3063573 | C | A |
| S_9373451 \| \| scaffold14851_3064083_SNP | 3064083 | A | C |
| S_9373997 \| \| scaffold14851_3070207_SNP | 3070207 | G | C |
| S_9374075 \| \| scaffold14851_3070734_SNP | 3070734 | C | T |
| S_9374076 \| \| scaffold14851_3070807_SNP | 3070807 | G | C |
| S_9374198 \| \| scaffold14851_3072605_SNP | 3072605 | G | A |
| S_9374208 \| \| scaffold14851_3072721_SNP | 3072721 | C | T |
| S_9374324 \| \| scaffold14851_3073648_SNP | 3073648 | G | A |
| S_9374342 \| \| scaffold14851_3074045_SNP | 3074045 | T | A |
| S_9374398 \| \| scaffold14851_3074884_SNP | 3074884 | G | T |
| S_9374399 \| \| scaffold14851_3074915_SNP | 3074915 | T | C |
| S_9374418 \| \| scaffold14851_3075130_SNP | 3075130 | A | G |
| S_9374479 \| \| scaffold14851_3076008_SNP | 3076008 | T | A |
| S_9374481 \| \| scaffold14851_3076032_SNP | 3076032 | A | C |
| S_9374482 \| \| scaffold14851_3076048_SNP | 3076048 | C | T |
| S_9374483 \| \| scaffold14851_3076061_SNP | 3076061 | C | T |
| S_9374505 \| \| scaffold14851_3076346_SNP | 3076346 | T | C |
| S_9374512 \| \| scaffold14851_3076447_SNP | 3076447 | T | G |
| S_9374523 \| \| scaffold14851_3076735_SNP | 3076735 | A | G |
| S_9374524 \| \| scaffold14851_3076738_SNP | 3076738 | T | G |
| S_9374525 \| \| scaffold14851_3076741_SNP | 3076741 | G | A |
| S_9374532 \| \| scaffold14851_3076835_SNP | 3076835 | C | T |
| S_9374534 \| \| scaffold14851_3076937_SNP | 3076937 | T | A |
| scaffold14851_3077420_SNP | 3077420 | A | C |
| S_9374602 \| \| scaffold14851_3077750_SNP | 3077750 | G | C |
| S_9374603 \| \| scaffold14851_3077752_SNP | 3077752 | T | A |
| S_9374609 \| \| scaffold14851_3077794_SNP | 3077794 | G | A |
| S_9374658 \| \| scaffold14851_3078430_SNP | 3078430 | C | A |
| S_9374666 \| \| scaffold14851_3078536_SNP | 3078536 | G | A |
| S_9374688 \| \| scaffold14851_3078770_SNP | 3078770 | A | G |
| S_9374690 \| \| scaffold14851_3078780_SNP | 3078780 | G | T |
| S_9374692 \| \| scaffold14851_3078806_SNP | 3078806 | T | C |
| S_9374716 \| \| scaffold14851_3079033_SNP | 3079033 | T | C |
| S_9374738 \| \| scaffold14851_3079229_SNP | 3079229 | T | A |
| S_9374739 \| \| scaffold14851_3079233_SNP | 3079233 | C | T |
| S_9374744 \| \| scaffold14851_3079266_SNP | 3079266 | T | C |
| S_9374883 \| \| scaffold14851_3080441_SNP | 3080441 | A | T |
| S_9374892 \| \| scaffold14851_3080594_SNP | 3080594 | C | T |
| S_9374932 \| \| scaffold14851_3081385_SNP | 3081385 | A | T |
| S_9374933 \| \| scaffold14851_3081392_SNP | 3081392 | A | T |
| S_9374974 \| \| scaffold14851_3082020_SNP | 3082020 | T | G |
| S_9375022 \| \| scaffold14851_3082863_SNP | 3082863 | A | T |
| S_9375027 \| \| scaffold14851_3082972_SNP | 3082972 | C | A |
| S_9375031 \| \| scaffold14851_3083025_SNP | 3083025 | C | T |
| S_9375032 \| \| scaffold14851_3083031_SNP | 3083031 | A | G |
| S_9375388 \| \| scaffold14851_3088167_SNP | 3088167 | A | G |
| S_9375667 \| \| scaffold14851_3091293_SNP | 3091293 | A | T |
| S_9375853 \| \| scaffold14851_3093870_SNP | 3093870 | T | C |
| S_9376049 \| \| scaffold14851_3095825_SNP | 3095825 | T | A |
| S_9376173 \| \| scaffold14851_3097508_SNP | 3097508 | T | C |
| S_9376174 \| \| scaffold14851_3097514_SNP | 3097514 | G | C |
| S_9376176 \| \| scaffold14851_3097524_SNP | 3097524 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9376194 \| \| scaffold14851_3097767_SNP | 3097767 | T | C |
| S_9376195 \| \| scaffold14851_3097778_SNP | 3097778 | A | G |
| S_9376196 \| \| scaffold14851_3097798_SNP | 3097798 | A | C |
| S_9376246 \| \| scaffold14851_3098201_SNP | 3098201 | A | G |
| S_9376249 \| \| scaffold14851_3098246_SNP | 3098246 | G | A |
| S_9376250 \| \| scaffold14851_3098249_SNP | 3098249 | G | A |
| S_9376252 \| \| scaffold14851_3098276_SNP | 3098276 | C | T |
| S_9376291 \| \| scaffold14851_3098613_SNP | 3098613 | G | C |
| S_9376300 \| \| scaffold14851_3098720_SNP | 3098720 | A | G |
| S_9376304 \| \| scaffold14851_3098762_SNP | 3098762 | C | T |
| S_9376308 \| \| scaffold14851_3098825_SNP | 3098825 | C | A |
| S_9376311 \| \| scaffold14851_3098834_SNP | 3098834 | C | T |
| S_9376314 \| \| scaffold14851_3098853_SNP | 3098853 | A | G |
| S_9376384 \| \| scaffold14851_3100124_SNP | 3100124 | C | T |
| S_9376399 \| \| scaffold14851_3100324_SNP | 3100324 | T | C |
| S_9376411 \| \| scaffold14851_3100460_SNP | 3100460 | A | G |
| S_9376451 \| \| scaffold14851_3100904_SNP | 3100904 | A | T |
| S_9376466 \| \| scaffold14851_3101148_SNP | 3101148 | T | G |
| S_9376470 \| \| scaffold14851_3101179_SNP | 3101179 | G | T |
| S_9376501 \| \| scaffold14851_3101581_SNP | 3101581 | T | C |
| S_9376516 \| \| scaffold14851_3101864_SNP | 3101864 | C | T |
| S_9376603 \| \| scaffold14851_3103060_SNP | 3103060 | G | T |
| S_9376622 \| \| scaffold14851_3103353_SNP | 3103353 | A | T |
| S_9376633 \| \| scaffold14851_3103473_SNP | 3103473 | G | A |
| S_9376641 \| \| scaffold14851_3103557_SNP | 3103557 | T | C |
| S_9376643 \| \| scaffold14851_3103601_SNP | 3103601 | T | C |
| S_9376648 \| \| scaffold14851_3103704_SNP | 3103704 | G | A |
| S_9376651 \| \| scaffold14851_3103759_SNP | 3103759 | A | G |
| S_9376709 \| \| scaffold14851_3104479_SNP | 3104479 | C | G |
| S_9376715 \| \| scaffold14851_3104548_SNP | 3104548 | T | A |
| S_9376716 \| \| scaffold14851_3104656_SNP | 3104656 | T | A |
| S_9376719 \| \| scaffold14851_3104682_SNP | 3104682 | A | C |
| S_9376734 \| \| scaffold14851_3104894_SNP | 3104894 | G | A |
| S_9376735 \| \| scaffold14851_3104900_SNP | 3104900 | A | G |
| S_9376738 \| \| scaffold14851_3104966_SNP | 3104966 | T | C |
| S_9376744 \| \| scaffold14851_3105003_SNP | 3105003 | C | T |
| S_9376746 \| \| scaffold14851_3105021_SNP | 3105021 | C | G |
| S_9376748 \| \| scaffold14851_3105033_SNP | 3105033 | C | T |
| S_9376774 \| \| scaffold14851_3105419_SNP | 3105419 | G | A |
| S_9376847 \| \| scaffold14851_3106421_SNP | 3106421 | A | G |
| S_9376848 \| \| scaffold14851_3106425_SNP | 3106425 | G | A |
| S_9376859 \| \| scaffold14851_3106575_SNP | 3106575 | A | C |
| S_9376860 \| \| scaffold14851_3106592_SNP | 3106592 | C | T |
| S_9376934 \| \| scaffold14851_3107718_SNP | 3107718 | T | G |
| S_9376938 \| \| scaffold14851_3107752_SNP | 3107752 | G | A |
| S_9376939 \| \| scaffold14851_3107770_SNP | 3107770 | A | T |
| S_9377002 \| \| scaffold14851_3108424_SNP | 3108424 | A | G |
| S_9377084 \| \| scaffold14851_3109691_SNP | 3109691 | C | T |
| S_9377111 \| \| scaffold14851_3110394_SNP | 3110394 | A | G |
| S_9377184 \| \| scaffold14851_3111478_SNP | 3111478 | C | T |
| S_9377188 \| \| scaffold14851_3111517_SNP | 3111517 | T | A |
| S_9377266 \| \| scaffold14851_3112037_SNP | 3112037 | T | G |
| S_9377271 \| \| scaffold14851_3112206_SNP | 3112206 | C | T |
| S_9377288 \| \| scaffold14851_3112483_SNP | 3112483 | A | T |
| S_9377328 \| \| scaffold14851_3113180_SNP | 3113180 | A | G |
| S_9377331 \| \| scaffold14851_3113191_SNP | 3113191 | G | T |
| S_9377332 \| \| scaffold14851_3113201_SNP | 3113201 | T | C |
| S_9377333 \| \| scaffold14851_3113225_SNP | 3113225 | C | T |
| S_9377336 \| \| scaffold14851_3113270_SNP | 3113270 | C | T |
| S_9377386 \| \| scaffold14851_3113788_SNP | 3113788 | A | T |
| S_9377399 \| \| scaffold14851_3113907_SNP | 3113907 | T | C |
| S_9377402 \| \| scaffold14851_3113934_SNP | 3113934 | A | G |
| S_9377403 \| \| scaffold14851_3113974_SNP | 3113974 | T | C |
| S_9377404 \| \| scaffold14851_3113975_SNP | 3113975 | T | A |
| S_9377619 \| \| scaffold14851_3116267_SNP | 3116267 | C | T |
| S_9377810 \| \| scaffold14851_3118243_SNP | 3118243 | A | C |
| S_9377846 \| \| scaffold14851_3118467_SNP | 3118467 | A | T |
| S_9377856 \| \| scaffold14851_3118582_SNP | 3118582 | A | C |
| S_9378050 \| \| scaffold14851_3122483_SNP | 3122483 | G | A |
| S_9378128 \| \| scaffold14851_3123249_SNP | 3123249 | C | A |
| S_9378153 \| \| scaffold14851_3123480_SNP | 3123480 | T | C |
| S_9378203 \| \| scaffold14851_3124381_SNP | 3124381 | G | A |
| S_9378204 \| \| scaffold14851_3124382_SNP | 3124382 | T | G |
| S_9378348 \| \| scaffold14851_3126921_SNP | 3126921 | A | C |

137

138

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9378424 \| \| scaffold14851_3127549_SNP | 3127549 | G | T |
| S_9378558 \| \| scaffold14851_3129297_SNP | 3129297 | A | G |
| S_9378615 \| \| scaffold14851_3130220_SNP | 3130220 | T | G |
| S_9378836 \| \| scaffold14851_3133610_SNP | 3133610 | G | T |
| S_9378936 \| \| scaffold14851_3134994_SNP | 3134994 | G | C |
| S_9379024 \| \| scaffold14851_3135929_SNP | 3135929 | A | C |
| S_9379092 \| \| scaffold14851_3136905_SNP | 3136905 | G | A |
| S_9379107 \| \| scaffold14851_3137096_SNP | 3137096 | T | A |
| S_9379236 \| \| scaffold14851_3138766_SNP | 3138766 | G | A |
| S_9379241 \| \| scaffold14851_3139041_SNP | 3139041 | C | A |
| S_9379242 \| \| scaffold14851_3139043_SNP | 3139043 | A | T |
| S_9379368 \| \| scaffold14851_3141043_SNP | 3141043 | G | A |
| S_9379369 \| \| scaffold14851_3141045_SNP | 3141045 | T | G |
| S_9379478 \| \| scaffold14851_3143383_SNP | 3143383 | C | T |
| S_9379622 \| \| scaffold14851_3144978_SNP | 3144978 | G | A |
| S_9379634 \| \| scaffold14851_3145254_SNP | 3145254 | A | G |
| S_9379758 \| \| scaffold14851_3147616_SNP | 3147616 | C | T |
| S_9380246 \| \| scaffold14851_3153795_SNP | 3153795 | T | G |
| S_9380503 \| \| scaffold14851_3157650_SNP | 3157650 | C | T |
| S_9380787 \| \| scaffold14851_3162327_SNP | 3162327 | T | C |
| S_9380797 \| \| scaffold14851_3162518_SNP | 3162518 | G | A |
| S_9381019 \| \| scaffold14851_3164913_SNP | 3164913 | C | T |
| S_9381135 \| \| scaffold14851_3165801_SNP | 3165801 | G | A |
| S_9381166 \| \| scaffold14851_3166212_SNP | 3166212 | A | G |
| S_9381181 \| \| scaffold14851_3166626_SNP | 3166626 | T | C |
| S_9381273 \| \| scaffold14851_3167686_SNP | 3167686 | T | A |
| S_9381274 \| \| scaffold14851_3167688_SNP | 3167688 | G | A |
| S_9381284 \| \| scaffold14851_3167859_SNP | 3167859 | T | G |
| S_9381295 \| \| scaffold14851_3167975_SNP | 3167975 | A | C |
| S_9381296 \| \| scaffold14851_3167982_SNP | 3167982 | T | A |
| S_9381302 \| \| scaffold14851_3168069_SNP | 3168069 | A | T |
| S_9381306 \| \| scaffold14851_3168176_SNP | 3168176 | T | C |
| S_9381327 \| \| scaffold14851_3168399_SNP | 3168399 | A | G |
| S_9381383 \| \| scaffold14851_3169143_SNP | 3169143 | T | G |
| S_9381431 \| \| scaffold14851_3169751_SNP | 3169751 | T | C |
| S_9381435 \| \| scaffold14851_3169844_SNP | 3169844 | G | A |
| S_9381444 \| \| scaffold14851_3169980_SNP | 3169980 | C | A |
| S_9381501 \| \| scaffold14851_3170788_SNP | 3170788 | A | C |
| S_9381692 \| \| scaffold14851_3172437_SNP | 3172437 | G | A |
| S_9381863 \| \| scaffold14851_3174371_SNP | 3174371 | T | C |
| S_9382017 \| \| scaffold14851_3176375_SNP | 3176375 | A | G |
| S_9382366 \| \| scaffold14851_3180712_SNP | 3180712 | G | T |
| S_9382385 \| \| scaffold14851_3180956_SNP | 3180956 | C | G |
| S_9382398 \| \| scaffold14851_3181232_SNP | 3181232 | G | C |
| S_9382625 \| \| scaffold14851_3184532_SNP | 3184532 | G | A |
| S_9382860 \| \| scaffold14851_3187670_SNP | 3187670 | A | C |
| S_9382985 \| \| scaffold14851_3189445_SNP | 3189445 | T | C |
| S_9382988 \| \| scaffold14851_3189469_SNP | 3189469 | C | A |
| S_9383123 \| \| scaffold14851_3191036_SNP | 3191036 | A | C |
| S_9383158 \| \| scaffold14851_3191700_SNP | 3191700 | A | G |
| S_9383187 \| \| scaffold14851_3192149_SNP | 3192149 | C | A |
| S_9383374 \| \| scaffold14851_3194799_SNP | 3194799 | G | T |
| S_9383750 \| \| scaffold14851_3199451_SNP | 3199451 | C | A |
| S_9383864 \| \| scaffold14851_3200472_SNP | 3200472 | G | T |
| S_9383969 \| \| scaffold14851_3202039_SNP | 3202039 | C | G |
| S_9384100 \| \| scaffold14851_3204154_SNP | 3204154 | T | G |
| S_9384190 \| \| scaffold14851_3205080_SNP | 3205080 | A | C |
| S_9384191 \| \| scaffold14851_3205084_SNP | 3205084 | A | G |
| S_9384192 \| \| scaffold14851_3205128_SNP | 3205128 | G | C |
| S_9384201 \| \| scaffold14851_3205289_SNP | 3205289 | G | T |
| S_9384215 \| \| scaffold14851_3205576_SNP | 3205576 | T | C |
| S_9384222 \| \| scaffold14851_3205699_SNP | 3205699 | G | A |
| S_9384395 \| \| scaffold14851_3208677_SNP | 3208677 | G | C |
| scaffold14851_3209553_SNP | 3209553 | T | A |
| S_9384473 \| \| scaffold14851_3209650_SNP | 3209650 | C | T |
| S_9384476 \| \| scaffold14851_3209663_SNP | 3209663 | T | C |
| S_9384480 \| \| scaffold14851_3209677_SNP | 3209677 | C | G |
| S_9384489 \| \| scaffold14851_3209760_SNP | 3209760 | A | T |
| S_9384510 \| \| scaffold14851_3209969_SNP | 3209969 | C | T |
| S_9384593 \| \| scaffold14851_3210501_SNP | 3210501 | T | G |
| S_9384624 \| \| scaffold14851_3210966_SNP | 3210966 | A | C |
| S_9384626 \| \| scaffold14851_3211011_SNP | 3211011 | C | T |
| S_9384629 \| \| scaffold14851_3211022_SNP | 3211022 | T | G |
| S_9384637 \| \| scaffold14851_3211088_SNP | 3211088 | C | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9384641 \| \| scaffold14851_3211121_SNP | 3211121 | G | A |
| S_9384646 \| \| scaffold14851_3211165_SNP | 3211165 | G | A |
| S_9384648 \| \| scaffold14851_3211223_SNP | 3211223 | G | A |
| S_9384717 \| \| scaffold14851_3211718_SNP | 3211718 | C | T |
| S_9384722 \| \| scaffold14851_3211743_SNP | 3211743 | G | A |
| S_9384797 \| \| scaffold14851_3212722_SNP | 3212722 | A | C |
| S_9384870 \| \| scaffold14851_3213614_SNP | 3213614 | A | G |
| scaffold14851_3214577_SNP | 3214577 | A | G |
| scaffold14851_3215085_SNP | 3215085 | C | G |
| S_9385060 \| \| scaffold14851_3215169_SNP | 3215169 | G | A |
| S_9385130 \| \| scaffold14851_3215578_SNP | 3215578 | A | G |
| S_9385208 \| \| scaffold14851_3216086_SNP | 3216086 | A | G |
| S_9387052 \| \| scaffold14851_3243920_SNP | 3243920 | T | A |
| S_9387631 \| \| scaffold14851_3251814_SNP | 3251814 | T | A |
| scaffold 14851_3253492_SNP | 3253492 | G | A |
| S_9387816 \| \| scaffold14851_3253645_SNP | 3253645 | A | G |
| S_9387878 \| \| scaffold14851_3254638_SNP | 3254638 | C | A |
| S_9387889 \| \| scaffold14851_3254692_SNP | 3254692 | C | T |
| S_9388044 \| \| scaffold14851_3256488_SNP | 3256488 | A | C |
| S_9388502 \| \| scaffold14851_3261395_SNP | 3261395 | T | C |
| S_9388690 \| \| scaffold14851_3263201_SNP | 3263201 | A | G |
| S_9388835 \| \| scaffold14851_3265384_SNP | 3265384 | G | A |
| S_9388942 \| \| scaffold14851_3266571_SNP | 3266571 | A | C |
| S_9389107 \| \| scaffold14851_3267971_SNP | 3267971 | T | C |
| S_9389845 \| \| scaffold14851_3274672_SNP | 3274672 | T | A |
| S_9389885 \| \| scaffold14851_3275655_SNP | 3275655 | T | C |
| S_9393008 \| \| scaffold14851_3291351_SNP | 3291351 | T | C |
| S_9393172 \| \| scaffold14851_3293738_SNP | 3293738 | C | A |
| S_9393173 \| \| scaffold14851_3293739_SNP | 3293739 | A | G |
| S_9393208 \| \| scaffold14851_3293990_SNP | 3293990 | A | G |
| scaffold14851_3294505_SNP | 3294505 | C | A |
| scaffold14851_3296156_SNP | 3296156 | G | T |
| S_9394210 \| \| scaffold14851_3309134_SNP | 3309134 | C | A |
| S_9394450 \| \| scaffold14851_3312049_SNP | 3312049 | A | T |
| S_9394484 \| \| scaffold14851_3312293_SNP | 3312293 | C | T |
| S_9394499 \| \| scaffold14851_3312446_SNP | 3312446 | C | A |
| S_9394716 \| \| scaffold14851_3315637_SNP | 3315637 | T | C |
| S_9395016 \| \| scaffold14851_3319759_SNP | 3319759 | T | G |
| S_9395076 \| \| scaffold14851_3321787_SNP | 3321787 | G | C |
| S_9395132 \| \| scaffold14851_3322276_SNP | 3322276 | A | T |
| S_9395198 \| \| scaffold14851_3323073_SNP | 3323073 | G | C |
| S_9395230 \| \| scaffold14851_3323463_SNP | 3323463 | C | A |
| S_9395286 \| \| scaffold14851_3324332_SNP | 3324332 | T | C |
| S_9395330 \| \| scaffold14851_3324854_SNP | 3324854 | G | C |
| S_9395333 \| \| scaffold14851_3324938_SNP | 3324938 | C | T |
| scaffold14851_3325050_SNP | 3325050 | A | C |
| S_9395722 \| \| scaffold14851_3329053_SNP | 3329053 | T | A |
| S_9395877 \| \| scaffold14851_3331648_SNP | 3331648 | T | A |
| S_9395950 \| \| scaffold14851_3332802_SNP | 3332802 | G | T |
| S_9395960 \| \| scaffold14851_3332965_SNP | 3332965 | G | A |
| S_9395998 \| \| scaffold14851_3333589_SNP | 3333589 | A | G |
| S_9396019 \| \| scaffold14851_3333789_SNP | 3333789 | G | C |
| S_9396023 \| \| scaffold14851_3333888_SNP | 3333888 | T | A |
| S_9396028 \| \| scaffold14851_3333988_SNP | 3333988 | C | T |
| S_9396069 \| \| scaffold14851_3334576_SNP | 3334576 | C | T |
| S_9396070 \| \| scaffold14851_3334626_SNP | 3334626 | A | T |
| S_9396082 \| \| scaffold14851_3334878_SNP | 3334878 | C | A |
| S_9396098 \| \| scaffold14851_3335153_SNP | 3335153 | G | T |
| S_9396099 \| \| scaffold14851_3335159_SNP | 3335159 | C | G |
| S_9396128 \| \| scaffold14851_3335411_SNP | 3335411 | G | A |
| S_9396211 \| \| scaffold14851_3336371_SNP | 3336371 | C | T |
| S_9396215 \| \| scaffold14851_3336429_SNP | 3336429 | A | C |
| S_9396221 \| \| scaffold14851_3336531_SNP | 3336531 | G | T |
| S_9396268 \| \| scaffold14851_3337095_SNP | 3337095 | G | A |
| S_9396273 \| \| scaffold14851_3337166_SNP | 3337166 | T | G |
| S_9396301 \| \| scaffold14851_3337618_SNP | 3337618 | T | A |
| S_9396459 \| \| scaffold14851_3339009_SNP | 3339009 | G | T |
| S_9396474 \| \| scaffold14851_3339252_SNP | 3339252 | C | T |
| S_9396488 \| \| scaffold14851_3339283_SNP | 3339283 | G | A |
| S_9396543 \| \| scaffold14851_3339610_SNP | 3339610 | G | T |
| S_9396554 \| \| scaffold14851_3339891_SNP | 3339891 | G | A |
| S_9396572 \| \| scaffold14851_3340129_SNP | 3340129 | C | T |
| S_9396584 \| \| scaffold14851_3340413_SNP | 3340413 | C | G |
| S_9396603 \| \| scaffold14851_3340910_SNP | 3340910 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| scaffold14851_3342840_SNP | 3342840 | A | G |
| S_9396803 \| \| scaffold14851_3343553_SNP | 3343553 | C | T |
| S_9396882 \| \| scaffold14851_3344712_SNP | 3344712 | T | A |
| S_9396891 \| \| scaffold14851_3344841_SNP | 3344841 | T | A |
| S_9396893 \| \| scaffold14851_3344910_SNP | 3344910 | T | A |
| S_9396901 \| \| scaffold14851_3345087_SNP | 3345087 | A | T |
| S_9396902 \| \| scaffold14851_3345125_SNP | 3345125 | A | G |
| S_9396904 \| \| scaffold14851_3345151_SNP | 3345151 | G | C |
| S_9396911 \| \| scaffold14851_3345208_SNP | 3345208 | A | G |
| S_9396913 \| \| scaffold14851_3345239_SNP | 3345239 | A | C |
| S_9396922 \| \| scaffold14851_3345410_SNP | 3345410 | A | G |
| S_9396923 \| \| scaffold14851_3345411_SNP | 3345411 | C | G |
| S_9396926 \| \| scaffold14851_3345470_SNP | 3345470 | T | A |
| S_9396927 \| \| scaffold14851_3345534_SNP | 3345534 | C | T |
| S_9396930 \| \| scaffold14851_3345641_SNP | 3345641 | C | G |
| S_9396942 \| \| scaffold14851_3345826_SNP | 3345826 | C | T |
| S_9396944 \| \| scaffold14851_3345878_SNP | 3345878 | T | C |
| S_9397039 \| \| scaffold14851_3346673_SNP | 3346673 | G | A |
| S_9397055 \| \| scaffold14851_3346857_SNP | 3346857 | T | C |
| S_9397057 \| \| scaffold14851_3346880_SNP | 3346880 | A | C |
| S_9397096 \| \| scaffold14851_3347403_SNP | 3347403 | T | C |
| S_9397121 \| \| scaffold14851_3347758_SNP | 3347758 | A | G |
| S_9397125 \| \| scaffold14851_3347807_SNP | 3347807 | G | A |
| S_9397128 \| \| scaffold14851_3347840_SNP | 3347840 | T | C |
| S_9397138 \| \| scaffold14851_3347923_SNP | 3347923 | A | G |
| S_9397149 \| \| scaffold14851_3348062_SNP | 3348062 | T | C |
| S_9397154 \| \| scaffold14851_3348125_SNP | 3348125 | T | C |
| S_9397155 \| \| scaffold14851_3348165_SNP | 3348165 | T | A |
| S_9397164 \| \| scaffold14851_3348283_SNP | 3348283 | T | G |
| S_9397167 \| \| scaffold14851_3348313_SNP | 3348313 | A | G |
| S_9397200 \| \| scaffold14851_3348627_SNP | 3348627 | C | T |
| S_9397286 \| \| scaffold14851_3349891_SNP | 3349891 | C | T |
| scaffold14851_3350016_SNP | 3350016 | G | A |
| S_9397344 \| \| scaffold14851_3350388_SNP | 3350388 | G | A |
| S_9397353 \| \| scaffold14851_3350520_SNP | 3350520 | G | A |
| S_9397360 \| \| scaffold14851_3350635_SNP | 3350635 | A | G |
| S_9397362 \| \| scaffold14851_3350664_SNP | 3350664 | T | C |
| S_9397384 \| \| scaffold14851_3351047_SNP | 3351047 | A | G |
| S_9397434 \| \| scaffold14851_3351750_SNP | 3351750 | A | G |
| S_9397439 \| \| scaffold14851_3351848_SNP | 3351848 | A | T |
| S_9397450 \| \| scaffold14851_3352108_SNP | 3352108 | A | C |
| S_9397561 \| \| scaffold14851_3354889_SNP | 3354889 | T | C |
| S_9397624 \| \| scaffold14851_3355988_SNP | 3355988 | G | A |
| S_9397654 \| \| scaffold14851_3356275_SNP | 3356275 | G | A |
| S_9397661 \| \| scaffold14851_3356391_SNP | 3356391 | G | A |
| S_9397665 \| \| scaffold14851_3356423_SNP | 3356423 | T | A |
| S_9397679 \| \| scaffold14851_3356585_SNP | 3356585 | T | A |
| S_9397680 \| \| scaffold14851_3356590_SNP | 3356590 | T | G |
| S_9397732 \| \| scaffold14851_3357292_SNP | 3357292 | A | T |
| S_9397737 \| \| scaffold14851_3357307_SNP | 3357307 | T | A |
| S_9397785 \| \| scaffold14851_3357645_SNP | 3357645 | A | T |
| S_9397908 \| \| scaffold14851_3358922_SNP | 3358922 | T | C |
| S_9397949 \| \| scaffold14851_3359119_SNP | 3359119 | A | C |
| S_9397960 \| \| scaffold14851_3359387_SNP | 3359387 | C | T |
| S_9397961 \| \| scaffold14851_3359389_SNP | 3359389 | A | G |
| scaffold14851_3359424_SNP | 3359424 | G | A |
| S_9397985 \| \| scaffold14851_3359472_SNP | 3359472 | T | C |
| scaffold14851_3359478_SNP | 3359478 | G | A |
| S_9398037 \| \| scaffold14851_3359701_SNP | 3359701 | A | G |
| S_9398171 \| \| scaffold14851_3360634_SNP | 3360634 | C | A |
| S_9398180 \| \| scaffold14851_3360775_SNP | 3360775 | T | C |
| S_9398311 \| \| scaffold14851_3361765_SNP | 3361765 | T | G |
| S_9398313 \| \| scaffold14851_3361815_SNP | 3361815 | C | G |
| S_9398314 \| \| scaffold14851_3361901_SNP | 3361901 | A | C |
| S_9398315 \| \| scaffold14851_3361904_SNP | 3361904 | C | A |
| S_9398326 \| \| scaffold14851_3362064_SNP | 3362064 | A | T |
| S_9398334 \| \| scaffold14851_3362313_SNP | 3362313 | T | C |
| S_9398500 \| \| scaffold14851_3364136_SNP | 3364136 | C | A |
| S_9398543 \| \| scaffold14851_3364528_SNP | 3364528 | A | T |
| S_9398558 \| \| scaffold14851_3364848_SNP | 3364848 | A | G |
| S_9398602 \| \| scaffold14851_3365862_SNP | 3365862 | A | T |
| S_9398603 \| \| scaffold14851_3365886_SNP | 3365886 | A | G |
| S_9398609 \| \| scaffold14851_3366091_SNP | 3366091 | C | A |
| S_9398613 \| \| scaffold14851_3366186_SNP | 3366186 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9398840 \| \| scaffold14851_3368119_SNP | 3368119 | C | A |
| S_9398873 \| \| scaffold14851_3368636_SNP | 3368636 | T | C |
| S_9398902 \| \| scaffold14851_3368746_SNP | 3368746 | C | T |
| S_9398929 \| \| scaffold14851_3368858_SNP | 3368858 | G | A |
| S_9398940 \| \| scaffold14851_3369108_SNP | 3369108 | T | G |
| S_9398941 \| \| scaffold14851_3369170_SNP | 3369170 | A | T |
| S_9398942 \| \| scaffold14851_3369187_SNP | 3369187 | T | A |
| S_9398943 \| \| scaffold14851_3369199_SNP | 3369199 | A | G |
| S_9398944 \| \| scaffold14851_3369202_SNP | 3369202 | T | C |
| S_9398967 \| \| scaffold14851_3369589_SNP | 3369589 | C | T |
| S_9398968 \| \| scaffold14851_3369591_SNP | 3369591 | A | T |
| S_9399076 \| \| scaffold14851_3370981_SNP | 3370981 | A | G |
| S_9399108 \| \| scaffold14851_3371170_SNP | 3371170 | A | G |
| S_9399120 \| \| scaffold14851_3371253_SNP | 3371253 | A | G |
| S_9399139 \| \| scaffold14851_3371294_SNP | 3371294 | A | G |
| S_9399207 \| \| scaffold14851_3371508_SNP | 3371508 | C | G |
| S_9399221 \| \| scaffold14851_3371686_SNP | 3371686 | C | G |
| S_9399237 \| \| scaffold14851_3372023_SNP | 3372023 | C | A |
| S_9399238 \| \| scaffold14851_3372051_SNP | 3372051 | T | C |
| S_9399245 \| \| scaffold14851_3372215_SNP | 3372215 | A | G |
| S_9399336 \| \| scaffold14851_3373485_SNP | 3373485 | A | G |
| S_9399337 \| \| scaffold14851_3373493_SNP | 3373493 | T | G |
| S_9399350 \| \| scaffold14851_3373635_SNP | 3373635 | C | A |
| S_9399369 \| \| scaffold14851_3373913_SNP | 3373913 | A | G |
| S_9399440 \| \| scaffold14851_3374813_SNP | 3374813 | A | C |
| S_9399441 \| \| scaffold14851_3374814_SNP | 3374814 | T | A |
| S_9399442 \| \| scaffold14851_3374818_SNP | 3374818 | A | T |
| S_9399533 \| \| scaffold14851_3376211_SNP | 3376211 | T | A |
| S_9399567 \| \| scaffold14851_3376521_SNP | 3376521 | T | C |
| S_9399630 \| \| scaffold14851_3377372_SNP | 3377372 | T | A |
| S_9399635 \| \| scaffold14851_3377474_SNP | 3377474 | A | T |
| S_9399651 \| \| scaffold14851_3378068_SNP | 3378068 | G | A |
| S_9399685 \| \| scaffold14851_3378779_SNP | 3378779 | A | C |
| S_9399739 \| \| scaffold14851_3379256_SNP | 3379256 | C | T |
| S_9399765 \| \| scaffold14851_3379605_SNP | 3379605 | C | A |
| S_9399774 \| \| scaffold14851_3379755_SNP | 3379755 | A | C |
| S_9399776 \| \| scaffold14851_3379762_SNP | 3379762 | T | A |
| S_9399777 \| \| scaffold14851_3379771_SNP | 3379771 | C | T |
| S_9399785 \| \| scaffold14851_3379876_SNP | 3379876 | G | A |
| S_9399787 \| \| scaffold14851_3379911_SNP | 3379911 | A | C |
| S_9399788 \| \| scaffold14851_3379925_SNP | 3379925 | C | A |
| S_9399889 \| \| scaffold14851_3381619_SNP | 3381619 | T | A |
| S_9399934 \| \| scaffold14851_3382466_SNP | 3382466 | C | G |
| S_9399982 \| \| scaffold14851_3382961_SNP | 3382961 | A | G |
| S_9400023 \| \| scaffold14851_3383924_SNP | 3383924 | T | C |
| S_9400505 \| \| scaffold14851_3390515_SNP | 3390515 | A | T |
| S_9400506 \| \| scaffold14851_3390518_SNP | 3390518 | G | T |
| S_9400812 \| \| scaffold14851_3393541_SNP | 3393541 | G | A |
| S_9400947 \| \| scaffold14851_3395243_SNP | 3395243 | A | T |
| S_9401164 \| \| scaffold14851_3398357_SNP | 3398357 | A | T |
| S_9401179 \| \| scaffold14851_3398602_SNP | 3398602 | C | T |
| S_9401186 \| \| scaffold14851_3398855_SNP | 3398855 | T | A |
| S_9401253 \| \| scaffold14851_3400241_SNP | 3400241 | A | G |
| S_9401257 \| \| scaffold14851_3400315_SNP | 3400315 | T | G |
| S_9401417 \| \| scaffold14851_3403516_SNP | 3403516 | T | A |
| S_9401541 \| \| scaffold14851_3405524_SNP | 3405524 | T | C |
| S_9401552 \| \| scaffold14851_3405731_SNP | 3405731 | G | T |
| S_9401577 \| \| scaffold14851_3406217_SNP | 3406217 | C | T |
| S_9401667 \| \| scaffold14851_3406912_SNP | 3406912 | G | T |
| S_9401678 \| \| scaffold14851_3407045_SNP | 3407045 | T | A |
| S_9401681 \| \| scaffold14851_3407088_SNP | 3407088 | T | C |
| S_9401692 \| \| scaffold14851_3407354_SNP | 3407354 | G | T |
| S_9401716 \| \| scaffold14851_3407617_SNP | 3407617 | T | A |
| S_9401722 \| \| scaffold14851_3407759_SNP | 3407759 | G | A |
| S_9401726 \| \| scaffold14851_3407864_SNP | 3407864 | T | C |
| S_9401748 \| \| scaffold14851_3408232_SNP | 3408232 | C | A |
| S_9401749 \| \| scaffold14851_3408233_SNP | 3408233 | T | A |
| S_9401964 \| \| scaffold14851_3410069_SNP | 3410069 | C | T |
| S_9402093 \| \| scaffold14851_3411688_SNP | 3411688 | T | A |
| S_9402097 \| \| scaffold14851_3411791_SNP | 3411791 | G | C |
| S_9402110 \| \| scaffold14851_3412002_SNP | 3412002 | G | A |
| S_9402169 \| \| scaffold14851_3412973_SNP | 3412973 | A | G |
| S_9402175 \| \| scaffold14851_3413060_SNP | 3413060 | A | G |
| S_9402279 \| \| scaffold14851_3414188_SNP | 3414188 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9402508 \| \| scaffold14851_3416610_SNP | 3416610 | C | T |
| S_9402523 \| \| scaffold14851_3416729_SNP | 3416729 | G | T |
| scaffold14851_3417688_SNP | 3417688 | T | A |
| S_9402743 \| \| scaffold14851_3418503_SNP | 3418503 | C | T |
| S_9402956 \| \| scaffold14851_3421993_SNP | 3421993 | A | T |
| S_9402966 \| \| scaffold14851_3422088_SNP | 3422088 | A | G |
| S_9403277 \| \| scaffold14851_3425152_SNP | 3425152 | C | G |
| S_9403812 \| \| scaffold14851_3431887_SNP | 3431887 | C | A |
| S_9403881 \| \| scaffold14851_3434098_SNP | 3434098 | C | A |
| S_9403989 \| \| scaffold14851_3434786_SNP | 3434786 | T | A |
| S_9404249 \| \| scaffold14851_3438026_SNP | 3438026 | C | A |
| S_9404251 \| \| scaffold14851_3438043_SNP | 3438043 | G | A |
| S_9404271 \| \| scaffold14851_3438551_SNP | 3438551 | T | A |
| S_9404275 \| \| scaffold14851_3438626_SNP | 3438626 | G | T |
| S_9404520 \| \| scaffold14851_3441756_SNP | 3441756 | A | G |
| S_9404529 \| \| scaffold14851_3442000_SNP | 3442000 | G | T |
| S_9404540 \| \| scaffold14851_3442100_SNP | 3442100 | G | T |
| S_9404551 \| \| scaffold14851_3442273_SNP | 3442273 | C | G |
| S_9404600 \| \| scaffold14851_3442959_SNP | 3442959 | C | T |
| S_9404661 \| \| scaffold14851_3443791_SNP | 3443791 | T | C |
| S_9404675 \| \| scaffold14851_3444007_SNP | 3444007 | T | C |
| S_9404690 \| \| scaffold14851_3444158_SNP | 3444158 | G | A |
| S_9404810 \| \| scaffold14851_3445394_SNP | 3445394 | G | C |
| S_9404885 \| \| scaffold14851_3446579_SNP | 3446579 | G | A |
| S_9404899 \| \| scaffold14851_3446752_SNP | 3446752 | T | C |
| S_9404922 \| \| scaffold14851_3447079_SNP | 3447079 | A | C |
| S_9405086 \| \| scaffold14851_3448729_SNP | 3448729 | T | C |
| S_9405651 \| \| scaffold14851_3457834_SNP | 3457834 | A | G |
| S_9405654 \| \| scaffold14851_3457853_SNP | 3457853 | C | T |
| S_9405690 \| \| scaffold14851_3458438_SNP | 3458438 | A | C |
| S_9405709 \| \| scaffold14851_3458741_SNP | 3458741 | C | A |
| S_9405711 \| \| scaffold14851_3458772_SNP | 3458772 | G | T |
| S_9405733 \| \| scaffold14851_3459161_SNP | 3459161 | G | T |
| S_9405736 \| \| scaffold14851_3459215_SNP | 3459215 | T | G |
| S_9405749 \| \| scaffold14851_3459359_SNP | 3459359 | T | C |
| S_9405797 \| \| scaffold14851_3460012_SNP | 3460012 | T | C |
| S_9405869 \| \| scaffold14851_3460894_SNP | 3460894 | A | G |
| S_9405870 \| \| scaffold14851_3460905_SNP | 3460905 | A | C |
| S_9405886 \| \| scaffold14851_3461252_SNP | 3461252 | A | T |
| S_9405929 \| \| scaffold14851_3461771_SNP | 3461771 | A | T |
| S_9405932 \| \| scaffold14851_3461787_SNP | 3461787 | G | T |
| S_9406159 \| \| scaffold14851_3464589_SNP | 3464589 | C | T |
| S_9406173 \| \| scaffold14851_3464775_SNP | 3464775 | A | T |
| S_9406244 \| \| scaffold14851_3465436_SNP | 3465436 | T | C |
| S_9406271 \| \| scaffold14851_3465886_SNP | 3465886 | C | T |
| S_9406341 \| \| scaffold14851_3466776_SNP | 3466776 | T | C |
| S_9406373 \| \| scaffold14851_3466963_SNP | 3466963 | G | A |
| S_9406476 \| \| scaffold14851_3468039_SNP | 3468039 | C | T |
| S_9406489 \| \| scaffold14851_3468280_SNP | 3468280 | A | G |
| S_9406494 \| \| scaffold14851_3468463_SNP | 3468463 | A | G |
| S_9406524 \| \| scaffold14851_3468859_SNP | 3468859 | C | T |
| S_9406557 \| \| scaffold14851_3469208_SNP | 3469208 | G | T |
| S_9406646 \| \| scaffold14851_3470705_SNP | 3470705 | A | G |
| S_9406663 \| \| scaffold14851_3471002_SNP | 3471002 | A | T |
| S_9406694 \| \| scaffold14851_3471618_SNP | 3471618 | C | T |
| S_9406805 \| \| scaffold14851_3473654_SNP | 3473654 | C | A |
| S_9406856 \| \| scaffold14851_3474162_SNP | 3474162 | C | T |
| S_9406867 \| \| scaffold14851_3474253_SNP | 3474253 | A | G |
| S_9406885 \| \| scaffold14851_3474513_SNP | 3474513 | A | T |
| S_9406922 \| \| scaffold14851_3475184_SNP | 3475184 | A | G |
| S_9406930 \| \| scaffold14851_3475300_SNP | 3475300 | T | A |
| S_9406936 \| \| scaffold14851_3475440_SNP | 3475440 | G | C |
| S_9406952 \| \| scaffold14851_3475665_SNP | 3475665 | T | A |
| S_9406977 \| \| scaffold14851_3476021_SNP | 3476021 | A | G |
| S_9406995 \| \| scaffold14851_3476078_SNP | 3476078 | A | G |
| S_9407004 \| \| scaffold14851_3476236_SNP | 3476236 | G | T |
| S_9407005 \| \| scaffold14851_3476237_SNP | 3476237 | A | G |
| S_9407006 \| \| scaffold14851_3476238_SNP | 3476238 | T | A |
| S_9407010 \| \| scaffold14851_3476325_SNP | 3476325 | T | C |
| S_9407011 \| \| scaffold14851_3476326_SNP | 3476326 | T | A |
| S_9407081 \| \| scaffold14851_3477401_SNP | 3477401 | A | G |
| S_9407136 \| \| scaffold14851_3477989_SNP | 3477989 | G | A |
| S_9407160 \| \| scaffold14851_3478566_SNP | 3478566 | T | A |
| S_9407178 \| \| scaffold14851_3478931_SNP | 3478931 | A | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9407198 \| \| scaffold14851_3479282_SNP | 3479282 | G | T |
| S_9407199 \| \| scaffold14851_3479288_SNP | 3479288 | C | T |
| S_9407201 \| \| scaffold14851_3479314_SNP | 3479314 | A | G |
| S_9407202 \| \| scaffold14851_3479318_SNP | 3479318 | C | T |
| S_9407208 \| \| scaffold14851_3479402_SNP | 3479402 | G | A |
| S_9407234 \| \| scaffold14851_3479638_SNP | 3479638 | A | G |
| S_9407257 \| \| scaffold14851_3479944_SNP | 3479944 | C | A |
| S_9407295 \| \| scaffold14851_3480554_SNP | 3480554 | G | C |
| S_9407296 \| \| scaffold14851_3480562_SNP | 3480562 | A | T |
| S_9407301 \| \| scaffold14851_3480687_SNP | 3480687 | C | T |
| S_9407324 \| \| scaffold14851_3480885_SNP | 3480885 | G | T |
| S_9407360 \| \| scaffold14851_3481353_SNP | 3481353 | T | A |
| S_9407368 \| \| scaffold14851_3481444_SNP | 3481444 | T | C |
| S_9407436 \| \| scaffold14851_3482195_SNP | 3482195 | A | C |
| S_9407477 \| \| scaffold14851_3482500_SNP | 3482500 | T | C |
| S_9407492 \| \| scaffold14851_3482616_SNP | 3482616 | T | C |
| S_9407533 \| \| scaffold14851_3482939_SNP | 3482939 | C | A |
| S_9407544 \| \| scaffold14851_3483028_SNP | 3483028 | T | C |
| S_9407557 \| \| scaffold14851_3483276_SNP | 3483276 | G | C |
| S_9407573 \| \| scaffold14851_3483470_SNP | 3483470 | G | A |
| S_9407585 \| \| scaffold14851_3483550_SNP | 3483550 | G | T |
| S_9407596 \| \| scaffold14851_3483700_SNP | 3483700 | G | T |
| S_9407603 \| \| scaffold14851_3483780_SNP | 3483780 | A | C |
| S_9407605 \| \| scaffold14851_3483788_SNP | 3483788 | G | A |
| S_9407664 \| \| scaffold14851_3484449_SNP | 3484449 | T | C |
| S_9407681 \| \| scaffold14851_3484663_SNP | 3484663 | C | A |
| S_9407684 \| \| scaffold14851_3484677_SNP | 3484677 | C | T |
| S_9407692 \| \| scaffold14851_3484720_SNP | 3484720 | T | C |
| S_9407697 \| \| scaffold14851_3484801_SNP | 3484801 | C | G |
| S_9407713 \| \| scaffold14851_3485144_SNP | 3485144 | A | C |
| S_9407715 \| \| scaffold14851_3485156_SNP | 3485156 | G | C |
| S_9407734 \| \| scaffold14851_3485496_SNP | 3485496 | C | G |
| S_9407743 \| \| scaffold14851_3485580_SNP | 3485580 | T | C |
| S_9407745 \| \| scaffold14851_3485588_SNP | 3485588 | A | G |
| S_9407747 \| \| scaffold14851_3485657_SNP | 3485657 | T | C |
| S_9407749 \| \| scaffold14851_3485670_SNP | 3485670 | G | C |
| S_9407778 \| \| scaffold14851_3486285_SNP | 3486285 | C | T |
| S_9407786 \| \| scaffold14851_3486375_SNP | 3486375 | G | A |
| S_9407815 \| \| scaffold14851_3486712_SNP | 3486712 | G | A |
| S_9407819 \| \| scaffold14851_3486766_SNP | 3486766 | A | G |
| S_9407823 \| \| scaffold14851_3486785_SNP | 3486785 | G | T |
| S_9407824 \| \| scaffold14851_3486841_SNP | 3486841 | T | C |
| S_9407972 \| \| scaffold14851_3488013_SNP | 3488013 | T | G |
| S_9407991 \| \| scaffold14851_3488354_SNP | 3488354 | G | A |
| S_9408007 \| \| scaffold14851_3489429_SNP | 3489429 | A | C |
| S_9408008 \| \| scaffold14851_3489503_SNP | 3489503 | G | A |
| S_9408030 \| \| scaffold14851_3489771_SNP | 3489771 | A | G |
| S_9408084 \| \| scaffold14851_3490235_SNP | 3490235 | C | T |
| S_9408118 \| \| scaffold14851_3490609_SNP | 3490609 | T | C |
| S_9408119 \| \| scaffold14851_3490618_SNP | 3490618 | G | C |
| S_9408121 \| \| scaffold14851_3490637_SNP | 3490637 | T | C |
| S_9408133 \| \| scaffold14851_3490822_SNP | 3490822 | T | G |
| S_9408186 \| \| scaffold14851_3491693_SNP | 3491693 | G | T |
| S_9408187 \| \| scaffold14851_3491708_SNP | 3491708 | T | G |
| S_9408216 \| \| scaffold14851_3491965_SNP | 3491965 | A | T |
| S_9408305 \| \| scaffold14851_3492694_SNP | 3492694 | A | G |
| S_9408383 \| \| scaffold14851_3493630_SNP | 3493630 | T | C |
| S_9408522 \| \| scaffold14851_3495344_SNP | 3495344 | T | C |
| S_9408524 \| \| scaffold14851_3495362_SNP | 3495362 | T | C |
| S_9408557 \| \| scaffold14851_3495645_SNP | 3495645 | C | T |
| S_9408693 \| \| scaffold14851_3497580_SNP | 3497580 | T | A |
| S_9408709 \| \| scaffold14851_3497705_SNP | 3497705 | T | G |
| S_9408732 \| \| scaffold14851_3498142_SNP | 3498142 | A | C |
| S_9408740 \| \| scaffold14851_3498288_SNP | 3498288 | G | T |
| S_9408743 \| \| scaffold14851_3498374_SNP | 3498374 | T | C |
| S_9408748 \| \| scaffold14851_3498449_SNP | 3498449 | T | A |
| S_9408753 \| \| scaffold14851_3498707_SNP | 3498707 | A | T |
| S_9408758 \| \| scaffold14851_3498874_SNP | 3498874 | A | C |
| S_9408761 \| \| scaffold14851_3498915_SNP | 3498915 | T | C |
| S_9408763 \| \| scaffold14851_3498926_SNP | 3498926 | G | A |
| S_9408768 \| \| scaffold14851_3499026_SNP | 3499026 | T | C |
| S_9408769 \| \| scaffold14851_3499049_SNP | 3499049 | T | A |
| S_9408791 \| \| scaffold14851_3499398_SNP | 3499398 | T | C |
| S_9408812 \| \| scaffold14851_3499758_SNP | 3499758 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9408858 \| \| scaffold14851_3500777_SNP | 3500777 | C | T |
| S_9409021 \| \| scaffold14851_3502376_SNP | 3502376 | A | C |
| S_9409024 \| \| scaffold14851_3502447_SNP | 3502447 | A | T |
| S_9409054 \| \| scaffold14851_3503033_SNP | 3503033 | C | T |
| S_9409061 \| \| scaffold14851_3503141_SNP | 3503141 | T | C |
| S_9409067 \| \| scaffold14851_3503239_SNP | 3503239 | A | G |
| S_9409076 \| \| scaffold14851_3503438_SNP | 3503438 | G | A |
| S_9409089 \| \| scaffold14851_3503536_SNP | 3503536 | T | G |
| S_9409091 \| \| scaffold14851_3503574_SNP | 3503574 | T | C |
| S_9409123 \| \| scaffold14851_3504088_SNP | 3504088 | G | A |
| S_9409189 \| \| scaffold14851_3505073_SNP | 3505073 | A | C |
| S_9409191 \| \| scaffold14851_3505100_SNP | 3505100 | A | T |
| S_9409192 \| \| scaffold14851_3505107_SNP | 3505107 | A | T |
| S_9409193 \| \| scaffold14851_3505114_SNP | 3505114 | C | A |
| S_9409195 \| \| scaffold14851_3505162_SNP | 3505162 | C | T |
| S_9409310 \| \| scaffold14851_3506058_SNP | 3506058 | C | T |
| S_9409312 \| \| scaffold14851_3506130_SNP | 3506130 | T | C |
| S_9409327 \| \| scaffold14851_3506387_SNP | 3506387 | T | C |
| S_9409328 \| \| scaffold14851_3506393_SNP | 3506393 | C | T |
| S_9409348 \| \| scaffold14851_3506775_SNP | 3506775 | T | G |
| S_9409449 \| \| scaffold14851_3508297_SNP | 3508297 | C | T |
| S_9409460 \| \| scaffold14851_3508474_SNP | 3508474 | G | C |
| S_9409461 \| \| scaffold14851_3508487_SNP | 3508487 | A | G |
| S_9409462 \| \| scaffold14851_3508526_SNP | 3508526 | T | A |
| S_9409686 \| \| scaffold14851_3511552_SNP | 3511552 | G | A |
| S_9409700 \| \| scaffold14851_3511873_SNP | 3511873 | T | A |
| S_9409707 \| \| scaffold14851_3511971_SNP | 3511971 | T | A |
| S_9409708 \| \| scaffold14851_3511986_SNP | 3511986 | A | T |
| S_9409718 \| \| scaffold14851_3512055_SNP | 3512055 | C | A |
| S_9409736 \| \| scaffold14851_3512219_SNP | 3512219 | C | T |
| S_9409757 \| \| scaffold14851_3512462_SNP | 3512462 | T | C |
| S_9409775 \| \| scaffold14851_3512755_SNP | 3512755 | C | T |
| S_9409785 \| \| scaffold14851_3512939_SNP | 3512939 | G | A |
| S_9409786 \| \| scaffold14851_3512943_SNP | 3512943 | T | C |
| S_9409789 \| \| scaffold14851_3513002_SNP | 3513002 | A | G |
| S_9409823 \| \| scaffold14851_3513510_SNP | 3513510 | T | A |
| S_9409842 \| \| scaffold14851_3513762_SNP | 3513762 | A | T |
| S_9409852 \| \| scaffold14851_3513879_SNP | 3513879 | C | A |
| S_9409858 \| \| scaffold14851_3513895_SNP | 3513895 | G | C |
| S_9409860 \| \| scaffold14851_3513917_SNP | 3513917 | C | T |
| S_9409862 \| \| scaffold14851_3513949_SNP | 3513949 | C | T |
| S_9409869 \| \| scaffold14851_3514091_SNP | 3514091 | G | C |
| S_9410026 \| \| scaffold14851_3516531_SNP | 3516531 | A | G |
| S_9410029 \| \| scaffold14851_3516597_SNP | 3516597 | T | A |
| S_9410128 \| \| scaffold14851_3517672_SNP | 3517672 | T | C |
| S_9410327 \| \| scaffold14851_3519661_SNP | 3519661 | G | C |
| S_9410329 \| \| scaffold14851_3519695_SNP | 3519695 | C | G |
| S_9410331 \| \| scaffold14851_3519735_SNP | 3519735 | T | C |
| S_9410332 \| \| scaffold14851_3519804_SNP | 3519804 | C | A |
| S_9410337 \| \| scaffold14851_3519911_SNP | 3519911 | G | T |
| S_9410338 \| \| scaffold14851_3519917_SNP | 3519917 | G | A |
| S_9410343 \| \| scaffold14851_3520003_SNP | 3520003 | A | G |
| S_9410344 \| \| scaffold14851_3520007_SNP | 3520007 | G | A |
| S_9410349 \| \| scaffold14851_3520068_SNP | 3520068 | A | G |
| S_9410361 \| \| scaffold14851_3520314_SNP | 3520314 | T | C |
| S_9410362 \| \| scaffold14851_3520355_SNP | 3520355 | T | C |
| S_9410363 \| \| scaffold14851_3520361_SNP | 3520361 | C | T |
| S_9410365 \| \| scaffold14851_3520375_SNP | 3520375 | T | A |
| S_9410375 \| \| scaffold14851_3520493_SNP | 3520493 | T | C |
| S_9410395 \| \| scaffold14851_3520648_SNP | 3520648 | G | A |
| S_9410437 \| \| scaffold14851_3521203_SNP | 3521203 | G | A |
| S_9410442 \| \| scaffold14851_3521246_SNP | 3521246 | A | G |
| S_9410447 \| \| scaffold14851_3521311_SNP | 3521311 | A | T |
| S_9410524 \| \| scaffold14851_3522344_SNP | 3522344 | G | T |
| S_9410525 \| \| scaffold14851_3522347_SNP | 3522347 | A | G |
| S_9410528 \| \| scaffold14851_3522424_SNP | 3522424 | T | G |
| S_9410529 \| \| scaffold14851_3522436_SNP | 3522436 | A | T |
| S_9410530 \| \| scaffold14851_3522441_SNP | 3522441 | T | C |
| S_9410532 \| \| scaffold14851_3522471_SNP | 3522471 | G | A |
| S_9410540 \| \| scaffold14851_3522678_SNP | 3522678 | C | A |
| S_9410553 \| \| scaffold14851_3522822_SNP | 3522822 | C | T |
| S_9410554 \| \| scaffold14851_3522827_SNP | 3522827 | A | T |
| S_9410620 \| \| scaffold14851_3524651_SNP | 3524651 | T | A |
| S_9410623 \| \| scaffold14851_3524697_SNP | 3524697 | A | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9410626 \| \| scaffold14851_3524740_SNP | 3524740 | T | C |
| S_9410639 \| \| scaffold14851_3524899_SNP | 3524899 | C | T |
| S_9410648 \| \| scaffold14851_3525056_SNP | 3525056 | T | C |
| S_9410649 \| \| scaffold14851_3525078_SNP | 3525078 | T | C |
| S_9410659 \| \| scaffold14851_3525258_SNP | 3525258 | A | G |
| S_9410660 \| \| scaffold14851_3525286_SNP | 3525286 | G | A |
| S_9410662 \| \| scaffold14851_3525331_SNP | 3525331 | G | T |
| S_9410663 \| \| scaffold14851_3525379_SNP | 3525379 | T | C |
| S_9410664 \| \| scaffold14851_3525387_SNP | 3525387 | C | T |
| S_9410670 \| \| scaffold14851_3525530_SNP | 3525530 | T | G |
| S_9410671 \| \| scaffold14851_3525548_SNP | 3525548 | A | T |
| S_9410728 \| \| scaffold14851_3527247_SNP | 3527247 | A | T |
| S_9410731 \| \| scaffold14851_3527311_SNP | 3527311 | A | G |
| S_9410733 \| \| scaffold14851_3527320_SNP | 3527320 | A | G |
| S_9410881 \| \| scaffold14851_3529239_SNP | 3529239 | G | T |
| S_9410918 \| \| scaffold14851_3529629_SNP | 3529629 | A | G |
| S_9410922 \| \| scaffold14851_3529656_SNP | 3529656 | C | A |
| S_9410923 \| \| scaffold14851_3529701_SNP | 3529701 | A | C |
| S_9410933 \| \| scaffold14851_3529790_SNP | 3529790 | A | T |
| S_9410937 \| \| scaffold14851_3529815_SNP | 3529815 | G | T |
| S_9410950 \| \| scaffold14851_3529926_SNP | 3529926 | C | T |
| S_9410956 \| \| scaffold14851_3529988_SNP | 3529988 | A | G |
| S_9410959 \| \| scaffold14851_3530011_SNP | 3530011 | A | G |
| scaffold14851_3530067_SNP | 3530067 | C | A |
| S_9410971 \| \| scaffold14851_3530090_SNP | 3530090 | T | C |
| S_9410986 \| \| scaffold14851_3530186_SNP | 3530186 | A | C |
| S_9410987 \| \| scaffold14851_3530193_SNP | 3530193 | C | T |
| scaffold14851_3542611_SNP | 3542611 | A | G |
| scaffold14851_3542628_SNP | 3542628 | A | G |
| S_9411587 \| \| scaffold14851_3547934_SNP | 3547934 | T | G |
| S_9411589 \| \| scaffold14851_3547984_SNP | 3547984 | G | C |
| S_9411599 \| \| scaffold14851_3548267_SNP | 3548267 | C | G |
| S_9411615 \| \| scaffold14851_3548342_SNP | 3548342 | A | G |
| S_9412050 \| \| scaffold14851_3558197_SNP | 3558197 | C | T |
| S_9412053 \| \| scaffold14851_3558290_SNP | 3558290 | T | G |
| S_9412066 \| \| scaffold14851_3558461_SNP | 3558461 | G | A |
| S_9412070 \| \| scaffold14851_3558518_SNP | 3558518 | G | A |
| S_9412075 \| \| scaffold14851_3558653_SNP | 3558653 | G | A |
| S_9412080 \| \| scaffold14851_3558705_SNP | 3558705 | A | C |
| S_9412089 \| \| scaffold14851_3558812_SNP | 3558812 | C | A |
| scaffold14851_3558905_SNP | 3558905 | C | T |
| S_9412187 \| \| scaffold14851_3560575_SNP | 3560575 | A | C |
| S_9412192 \| \| scaffold14851_3560664_SNP | 3560664 | G | T |
| S_9412703 \| \| scaffold14851_3567546_SNP | 3567546 | T | G |
| S_9413315 \| \| scaffold14851_3586982_SNP | 3586982 | T | A |
| S_9415882 \| \| scaffold14851_3602699_SNP | 3602699 | G | A |
| S_9415883 \| \| scaffold14851_3602707_SNP | 3602707 | C | T |
| S_9415895 \| \| scaffold14851_3602929_SNP | 3602929 | C | T |
| S_9415924 \| \| scaffold14851_3603301_SNP | 3603301 | T | A |
| S_9415934 \| \| scaffold14851_3603496_SNP | 3603496 | C | A |
| S_9415940 \| \| scaffold14851_3603538_SNP | 3603538 | C | T |
| S_9416037 \| \| scaffold14851_3605186_SNP | 3605186 | C | A |
| S_9416040 \| \| scaffold14851_3605264_SNP | 3605264 | A | G |
| S_9416041 \| \| scaffold14851_3605268_SNP | 3605268 | T | C |
| S_9416154 \| \| scaffold14851_3606839_SNP | 3606839 | T | C |
| S_9416155 \| \| scaffold14851_3606840_SNP | 3606840 | T | C |
| S_9416159 \| \| scaffold14851_3606881_SNP | 3606881 | C | T |
| S_9416160 \| \| scaffold14851_3606883_SNP | 3606883 | C | G |
| S_9416165 \| \| scaffold14851_3606960_SNP | 3606960 | T | C |
| S_9416173 \| \| scaffold14851_3607122_SNP | 3607122 | T | C |
| S_9416175 \| \| scaffold14851_3607135_SNP | 3607135 | G | A |
| S_9416176 \| \| scaffold14851_3607147_SNP | 3607147 | G | C |
| S_9416227 \| \| scaffold14851_3608025_SNP | 3608025 | G | A |
| S_9416235 \| \| scaffold14851_3608142_SNP | 3608142 | G | A |
| S_9416236 \| \| scaffold14851_3608148_SNP | 3608148 | C | T |
| S_9416255 \| \| scaffold14851_3608392_SNP | 3608392 | A | G |
| S_9416257 \| \| scaffold14851_3608409_SNP | 3608409 | T | G |
| S_9416279 \| \| scaffold14851_3608504_SNP | 3608504 | G | A |
| S_9416354 \| \| scaffold14851_3608753_SNP | 3608753 | A | G |
| S_9416369 \| \| scaffold14851_3608975_SNP | 3608975 | A | T |
| S_9416377 \| \| scaffold14851_3609211_SNP | 3609211 | T | A |
| S_9416458 \| \| scaffold14851_3610262_SNP | 3610262 | A | G |
| S_9416478 \| \| scaffold14851_3610549_SNP | 3610549 | G | A |
| S_9416479 \| \| scaffold14851_3610552_SNP | 3610552 | C | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9416552 \| \| scaffold14851_3611611_SNP | 3611611 | T | A |
| S_9416575 \| \| scaffold14851_3611996_SNP | 3611996 | G | T |
| S_9416702 \| \| scaffold14851_3613178_SNP | 3613178 | G | T |
| S_9416707 \| \| scaffold14851_3613280_SNP | 3613280 | G | T |
| S_9416719 \| \| scaffold14851_3613566_SNP | 3613566 | T | C |
| S_9416722 \| \| scaffold14851_3613586_SNP | 3613586 | T | C |
| S_9416749 \| \| scaffold14851_3614094_SNP | 3614094 | T | G |
| S_9416789 \| \| scaffold14851_3614679_SNP | 3614679 | G | A |
| S_9416794 \| \| scaffold14851_3614760_SNP | 3614760 | G | T |
| S_9416870 \| \| scaffold14851_3616094_SNP | 3616094 | G | A |
| S_9416999 \| \| scaffold14851_3618066_SNP | 3618066 | A | G |
| S_9417021 \| \| scaffold14851_3618743_SNP | 3618743 | G | A |
| S_9417054 \| \| scaffold14851_3619883_SNP | 3619883 | A | G |
| S_9417063 \| \| scaffold14851_3620128_SNP | 3620128 | G | A |
| S_9417086 \| \| scaffold14851_3620453_SNP | 3620453 | A | G |
| S_9417104 \| \| scaffold14851_3620663_SNP | 3620663 | G | A |
| S_9417233 \| \| scaffold14851_3621912_SNP | 3621912 | T | G |
| S_9417239 \| \| scaffold14851_3622062_SNP | 3622062 | T | A |
| S_9417270 \| \| scaffold14851_3622517_SNP | 3622517 | C | G |
| S_9417276 \| \| scaffold14851_3622586_SNP | 3622586 | T | A |
| S_9417362 \| \| scaffold14851_3623244_SNP | 3623244 | C | T |
| S_9417365 \| \| scaffold14851_3623289_SNP | 3623289 | T | C |
| S_9417434 \| \| scaffold14851_3624480_SNP | 3624480 | G | T |
| S_9417450 \| \| scaffold14851_3624713_SNP | 3624713 | T | C |
| S_9417477 \| \| scaffold14851_3625069_SNP | 3625069 | T | A |
| S_9417478 \| \| scaffold14851_3625078_SNP | 3625078 | T | C |
| S_9417481 \| \| scaffold14851_3625124_SNP | 3625124 | C | T |
| S_9417483 \| \| scaffold14851_3625137_SNP | 3625137 | G | C |
| S_9417484 \| \| scaffold14851_3625150_SNP | 3625150 | G | A |
| S_9417489 \| \| scaffold14851_3625243_SNP | 3625243 | G | A |
| S_9417506 \| \| scaffold14851_3625526_SNP | 3625526 | G | A |
| S_9417523 \| \| scaffold14851_3625878_SNP | 3625878 | G | A |
| S_9417530 \| \| scaffold14851_3626026_SNP | 3626026 | T | A |
| S_9417550 \| \| scaffold14851_3626321_SNP | 3626321 | T | G |
| S_9417566 \| \| scaffold14851_3626623_SNP | 3626623 | T | A |
| S_9417596 \| \| scaffold14851_3627128_SNP | 3627128 | T | G |
| S_9417614 \| \| scaffold14851_3627447_SNP | 3627447 | A | G |
| S_9417688 \| \| scaffold14851_3628434_SNP | 3628434 | C | T |
| S_9417698 \| \| scaffold14851_3628614_SNP | 3628614 | C | A |
| S_9417699 \| \| scaffold14851_3628634_SNP | 3628634 | T | C |
| S_9417702 \| \| scaffold14851_3628669_SNP | 3628669 | A | C |
| S_9417714 \| \| scaffold14851_3628867_SNP | 3628867 | C | T |
| S_9417715 \| \| scaffold14851_3628875_SNP | 3628875 | A | C |
| S_9417820 \| \| scaffold14851_3630427_SNP | 3630427 | G | T |
| S_9417824 \| \| scaffold14851_3630480_SNP | 3630480 | T | C |
| S_9417887 \| \| scaffold14851_3631343_SNP | 3631343 | G | T |
| S_9417983 \| \| scaffold14851_3632190_SNP | 3632190 | A | G |
| S_9417987 \| \| scaffold14851_3632287_SNP | 3632287 | C | T |
| S_9418126 \| \| scaffold14851_3633424_SNP | 3633424 | C | T |
| S_9418147 \| \| scaffold14851_3633717_SNP | 3633717 | C | T |
| S_9418223 \| \| scaffold14851_3634845_SNP | 3634845 | T | C |
| S_9418264 \| \| scaffold14851_3635238_SNP | 3635238 | T | C |
| S_9418280 \| \| scaffold14851_3635512_SNP | 3635512 | C | T |
| S_9418310 \| \| scaffold14851_3635938_SNP | 3635938 | A | T |
| S_9418345 \| \| scaffold14851_3636418_SNP | 3636418 | T | C |
| scaffold14851_3636437_SNP | 3636437 | C | T |
| S_9418354 \| \| scaffold14851_3636547_SNP | 3636547 | A | T |
| scaffold14851_3636615_SNP | 3636615 | G | A |
| S_9418357 \| \| scaffold14851_3636629_SNP | 3636629 | T | C |
| S_9418358 \| \| scaffold14851_3636630_SNP | 3636630 | T | C |
| S_9418395 \| \| scaffold14851_3637084_SNP | 3637084 | C | T |
| S_9418453 \| \| scaffold14851_3637743_SNP | 3637743 | A | G |
| S_9418596 \| \| scaffold14851_3638843_SNP | 3638843 | A | T |
| S_9418605 \| \| scaffold14851_3638907_SNP | 3638907 | A | G |
| S_9418608 \| \| scaffold14851_3638917_SNP | 3638917 | T | A |
| S_9418736 \| \| scaffold14851_3640723_SNP | 3640723 | A | T |
| S_9418795 \| \| scaffold14851_3641666_SNP | 3641666 | G | A |
| S_9418797 \| \| scaffold14851_3641687_SNP | 3641687 | A | G |
| scaffold14851_3641811_SNP | 3641811 | G | T |
| S_9418837 \| \| scaffold14851_3642219_SNP | 3642219 | A | T |
| S_9418900 \| \| scaffold14851_3642962_SNP | 3642962 | A | G |
| S_9418901 \| \| scaffold14851_3642963_SNP | 3642963 | C | G |
| S_9418937 \| \| scaffold14851_3643482_SNP | 3643482 | G | A |
| S_9418938 \| \| scaffold14851_3643499_SNP | 3643499 | T | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9418939 \| \| scaffold14851_3643502_SNP | 3643502 | T | C |
| S_9418997 \| \| scaffold14851_3644680_SNP | 3644680 | C | G |
| S_9419054 \| \| scaffold14851_3646116_SNP | 3646116 | G | A |
| S_9419075 \| \| scaffold14851_3646309_SNP | 3646309 | C | T |
| scaffold14851_3646339_SNP | 3646339 | A | T |
| scaffold14851_3646348_SNP | 3646348 | G | A |
| S_9419084 \| \| scaffold14851_3646398_SNP | 3646398 | A | C |
| S_9419116 \| \| scaffold14851_3646791_SNP | 3646791 | G | C |
| S_9419125 \| \| scaffold14851_3646998_SNP | 3646998 | T | A |
| S_9419164 \| \| scaffold14851_3647522_SNP | 3647522 | G | T |
| scaffold14851_3647661_SNP | 3647661 | C | T |
| S_9419177 \| \| scaffold14851_3647712_SNP | 3647712 | C | T |
| S_9419219 \| \| scaffold14851_3648060_SNP | 3648060 | G | C |
| S_9419250 \| \| scaffold14851_3648451_SNP | 3648451 | C | T |
| S_9419253 \| \| scaffold14851_3648457_SNP | 3648457 | G | A |
| S_9419259 \| \| scaffold14851_3648517_SNP | 3648517 | A | G |
| scaffold14851_3648544_SNP | 3648544 | G | A |
| S_9419325 \| \| scaffold14851_3649159_SNP | 3649159 | C | A |
| S_9419339 \| \| scaffold14851_3649389_SNP | 3649389 | C | G |
| S_9419345 \| \| scaffold14851_3649547_SNP | 3649547 | A | G |
| S_9419352 \| \| scaffold14851_3649688_SNP | 3649688 | T | C |
| S_9419356 \| \| scaffold14851_3649790_SNP | 3649790 | G | A |
| S_9419375 \| \| scaffold14851_3650256_SNP | 3650256 | G | A |
| S_9419377 \| \| scaffold14851_3650304_SNP | 3650304 | G | A |
| S_9419477 \| \| scaffold14851_3651572_SNP | 3651572 | G | A |
| S_9419539 \| \| scaffold14851_3652671_SNP | 3652671 | C | A |
| S_9419550 \| \| scaffold14851_3652738_SNP | 3652738 | T | G |
| scaffold14851_3652898_SNP | 3652898 | A | T |
| S_9419580 \| \| scaffold14851_3653172_SNP | 3653172 | G | A |
| S_9419585 \| \| scaffold14851_3653221_SNP | 3653221 | A | T |
| S_9419635 \| \| scaffold14851_3653786_SNP | 3653786 | G | A |
| scaffold14851_3654485_SNP | 3654485 | A | C |
| S_9419779 \| \| scaffold14851_3655191_SNP | 3655191 | C | A |
| S_9419780 \| \| scaffold14851_3655193_SNP | 3655193 | A | T |
| S_9419781 \| \| scaffold14851_3655307_SNP | 3655307 | A | T |
| S_9420017 \| \| scaffold14851_3658448_SNP | 3658448 | G | A |
| S_9420087 \| \| scaffold14851_3659762_SNP | 3659762 | G | T |
| S_9420093 \| \| scaffold14851_3659882_SNP | 3659882 | G | C |
| S_9420099 \| \| scaffold14851_3659930_SNP | 3659930 | T | G |
| scaffold14851_3660507_SNP | 3660507 | T | G |
| S_9420144 \| \| scaffold14851_3660829_SNP | 3660829 | T | G |
| S_9420147 \| \| scaffold14851_3660848_SNP | 3660848 | C | T |
| S_9420148 \| \| scaffold14851_3660899_SNP | 3660899 | A | G |
| S_9420150 \| \| scaffold14851_3660935_SNP | 3660935 | G | T |
| S_9420247 \| \| scaffold14851_3662526_SNP | 3662526 | G | A |
| S_9420271 \| \| scaffold14851_3662969_SNP | 3662969 | T | C |
| S_9420274 \| \| scaffold14851_3663056_SNP | 3663056 | T | C |
| S_9420305 \| \| scaffold14851_3663433_SNP | 3663433 | C | G |
| S_9420312 \| \| scaffold14851_3663492_SNP | 3663492 | C | T |
| S_9420314 \| \| scaffold14851_3663512_SNP | 3663512 | C | T |
| S_9420318 \| \| scaffold14851_3663572_SNP | 3663572 | G | A |
| S_9420330 \| \| scaffold14851_3663736_SNP | 3663736 | G | A |
| S_9420338 \| \| scaffold14851_3663799_SNP | 3663799 | C | T |
| S_9420380 \| \| scaffold14851_3664200_SNP | 3664200 | C | A |
| S_9420381 \| \| scaffold14851_3664204_SNP | 3664204 | G | T |
| S_9420392 \| \| scaffold14851_3664361_SNP | 3664361 | C | T |
| S_9420417 \| \| scaffold14851_3664536_SNP | 3664536 | G | T |
| S_9420456 \| \| scaffold14851_3665086_SNP | 3665086 | A | T |
| S_9420464 \| \| scaffold14851_3665221_SNP | 3665221 | T | C |
| S_9420480 \| \| scaffold14851_3665534_SNP | 3665534 | A | T |
| $_9420584 \| \| scaffold14851_3666827_SNP | 3666827 | G | C |
| S_9420585 \| \| scaffold14851_3666840_SNP | 3666840 | G | A |
| S_9420685 \| \| scaffold14851_3668306_SNP | 3668306 | C | T |
| S_9420703 \| \| scaffold14851_3668489_SNP | 3668489 | G | A |
| S_9420715 \| \| scaffold14851_3668684_SNP | 3668684 | A | C |
| S_9420772 \| \| scaffold14851_3669664_SNP | 3669664 | C | A |
| S_9420776 \| \| scaffold14851_3669726_SNP | 3669726 | T | C |
| S_9420778 \| \| scaffold14851_3669732_SNP | 3669732 | A | T |
| S_9420803 \| \| scaffold14851_3670051_SNP | 3670051 | C | T |
| S_9420810 \| \| scaffold14851_3670162_SNP | 3670162 | A | G |
| S_9420813 \| \| scaffold14851_3670268_SNP | 3670268 | A | G |
| S_9420820 \| \| scaffold14851_3670359_SNP | 3670359 | A | C |
| S_9420944 \| \| scaffold14851_3672306_SNP | 3672306 | C | T |
| S_9420992 \| \| scaffold14851_3673030_SNP | 3673030 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9420993 \| \| scaffold14851_3673076_SNP | 3673076 | C | T |
| scaffold14851_3674681_SNP | 3674681 | G | A |
| S_9421132 \| \| scaffold14851_3675604_SNP | 3675604 | T | C |
| S_9421188 \| \| scaffold14851_3676294_SNP | 3676294 | C | T |
| S_9421317 \| \| scaffold14851_3678288_SNP | 3678288 | A | G |
| S_9421338 \| \| scaffold14851_3678642_SNP | 3678642 | C | A |
| S_9421816 \| \| scaffold14851_3683608_SNP | 3683608 | G | T |
| scaffold14851_3685389_SNP | 3685389 | G | A |
| S_9422016 \| \| scaffold14851_3685610_SNP | 3685610 | G | A |
| S_9422373 \| \| scaffold14851_3690431_SNP | 3690431 | T | A |
| S_9422479 \| \| scaffold14851_3691942_SNP | 3691942 | T | A |
| scaffold14851_3694829_SNP | 3694829 | G | A |
| S_9422799 \| \| scaffold14851_3695158_SNP | 3695158 | G | A |
| scaffold14851_3695218_SNP | 3695218 | G | A |
| S_9422834 \| \| scaffold14851_3695381_SNP | 3695381 | T | C |
| S_9422843 \| \| scaffold14851_3695432_SNP | 3695432 | G | A |
| S_9422857 \| \| scaffold14851_3695594_SNP | 3695594 | A | G |
| S_9422859 \| \| scaffold14851_3695646_SNP | 3695646 | G | A |
| S_9422860 \| \| scaffold14851_3695734_SNP | 3695734 | A | C |
| S_9422864 \| \| scaffold14851_3695813_SNP | 3695813 | G | A |
| S_9422880 \| \| scaffold14851_3696003_SNP | 3696003 | T | A |
| S_9422883 \| \| scaffold14851_3696053_SNP | 3696053 | A | G |
| S_9422886 \| \| scaffold14851_3696084_SNP | 3696084 | A | G |
| scaffold14851_3697256_SNP | 3697256 | T | C |
| S_9423414 \| \| scaffold14851_3700760_SNP | 3700760 | C | T |
| scaffold14851_3701199_SNP | 3701199 | A | G |
| S_9423543 \| \| scaffold14851_3701612_SNP | 3701612 | C | T |
| S_9423554 \| \| scaffold14851_3701897_SNP | 3701897 | A | T |
| S_9424101 \| \| scaffold14851_3708680_SNP | 3708680 | T | C |
| S_9424222 \| \| scaffold14851_3710390_SNP | 3710390 | T | G |
| S_9424235 \| \| scaffold14851_3710613_SNP | 3710613 | C | T |
| S_9424276 \| \| scaffold14851_3711165_SNP | 3711165 | C | G |
| S_9424326 \| \| scaffold14851_3711868_SNP | 3711868 | G | A |
| S_9424334 \| \| scaffold14851_3711973_SNP | 3711973 | T | A |
| S_9424389 \| \| scaffold14851_3712708_SNP | 3712708 | G | A |
| S_9424433 \| \| scaffold14851_3713374_SNP | 3713374 | T | G |
| S_9424458 \| \| scaffold14851_3713722_SNP | 3713722 | A | C |
| S_9424510 \| \| scaffold14851_3714672_SNP | 3714672 | C | T |
| S_9424525 \| \| scaffold14851_3714865_SNP | 3714865 | T | C |
| S_9424543 \| \| scaffold14851_3715154_SNP | 3715154 | A | T |
| S_9424589 \| \| scaffold14851_3716032_SNP | 3716032 | C | A |
| S_9424646 \| \| scaffold14851_3717318_SNP | 3717318 | C | G |
| S_9424739 \| \| scaffold14851_3718583_SNP | 3718583 | A | G |
| S_9424746 \| \| scaffold14851_3718759_SNP | 3718759 | A | G |
| S_9424750 \| \| scaffold14851_3718839_SNP | 3718839 | G | A |
| S_9424751 \| \| scaffold14851_3718851_SNP | 3718851 | C | T |
| S_9424758 \| \| scaffold14851_3719059_SNP | 3719059 | G | A |
| S_9424761 \| \| scaffold14851_3719098_SNP | 3719098 | A | T |
| S_9424775 \| \| scaffold14851_3719511_SNP | 3719511 | C | A |
| S_9424776 \| \| scaffold14851_3719514_SNP | 3719514 | T | G |
| S_9424789 \| \| scaffold14851_3719673_SNP | 3719673 | T | C |
| S_9424790 \| \| scaffold14851_3719674_SNP | 3719674 | G | A |
| S_9424895 \| \| scaffold14851_3720699_SNP | 3720699 | A | G |
| S_9424928 \| \| scaffold14851_3721026_SNP | 3721026 | T | G |
| S_9424934 \| \| scaffold14851_3721067_SNP | 3721067 | G | T |
| S_9424958 \| \| scaffold14851_3721473_SNP | 3721473 | C | T |
| S_9425001 \| \| scaffold14851_3722066_SNP | 3722066 | A | T |
| S_9425030 \| \| scaffold14851_3722446_SNP | 3722446 | C | T |
| S_9425074 \| \| scaffold14851_3722737_SNP | 3722737 | A | C |
| S_9425075 \| \| scaffold14851_3722794_SNP | 3722794 | A | G |
| S_9425076 \| \| scaffold14851_3722797_SNP | 3722797 | T | C |
| S_9425077 \| \| scaffold14851_3722799_SNP | 3722799 | G | A |
| S_9425078 \| \| scaffold14851_3722803_SNP | 3722803 | C | T |
| S_9425083 \| \| scaffold14851_3722966_SNP | 3722966 | C | T |
| S_9425099 \| \| scaffold14851_3723167_SNP | 3723167 | G | A |
| S_9425103 \| \| scaffold14851_3723229_SNP | 3723229 | G | C |
| S_9425124 \| \| scaffold14851_3723492_SNP | 3723492 | T | A |
| S_9425138 \| \| scaffold14851_3723599_SNP | 3723599 | T | A |
| S_9425142 \| \| scaffold14851_3723633_SNP | 3723633 | A | G |
| S_9425743 \| \| scaffold14851_3726472_SNP | 3726472 | A | T |
| S_9425753 \| \| scaffold14851_3726553_SNP | 3726553 | A | G |
| S_9425756 \| \| scaffold14851_3726593_SNP | 3726593 | T | C |
| S_9425766 \| \| scaffold14851_3726858_SNP | 3726858 | T | A |
| S_9425778 \| \| scaffold14851_3727088_SNP | 3727088 | T | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9425779 \| \| scaffold14851_3727091_SNP | 3727091 | A | C |
| S_9425781 \| \| scaffold14851_3727113_SNP | 3727113 | C | T |
| S_9426026 \| \| scaffold14851_3729363_SNP | 3729363 | G | A |
| S_9426084 \| \| scaffold14851_3729728_SNP | 3729728 | A | G |
| S_9426085 \| \| scaffold14851_3729733_SNP | 3729733 | G | A |
| S_9426138 \| \| scaffold14851_3730105_SNP | 3730105 | A | G |
| S_9426139 \| \| scaffold14851_3730119_SNP | 3730119 | A | G |
| S_9426165 \| \| scaffold14851_3730424_SNP | 3730424 | C | A |
| S_9426204 \| \| scaffold14851_3730808_SNP | 3730808 | C | T |
| S_9426215 \| \| scaffold14851_3730957_SNP | 3730957 | G | C |
| scaffold14851_3731126_SNP | 3731126 | G | C |
| scaffold14851_3731382_SNP | 3731382 | C | T |
| S_9426263 \| \| scaffold14851_3731449_SNP | 3731449 | C | T |
| S_9426267 \| \| scaffold14851_3731486_SNP | 3731486 | A | G |
| S_9426304 \| \| scaffold14851_3731894_SNP | 3731894 | G | C |
| S_9426452 \| \| scaffold14851_3732649_SNP | 3732649 | T | A |
| S_9426546 \| \| scaffold14851_3733754_SNP | 3733754 | A | T |
| S_9426553 \| \| scaffold14851_3733849_SNP | 3733849 | T | A |
| S_9426568 \| \| scaffold14851_3734197_SNP | 3734197 | A | G |
| S_9426596 \| \| scaffold14851_3734473_SNP | 3734473 | T | C |
| S_9426654 \| \| scaffold14851_3734846_SNP | 3734846 | T | C |
| S_9427004 \| \| scaffold14851_3740478_SNP | 3740478 | T | A |
| S_9427614 \| \| scaffold14851_3745822_SNP | 3745822 | T | G |
| S_9427615 \| \| scaffold14851_3745827_SNP | 3745827 | G | C |
| S_9427761 \| \| scaffold14851_3747168_SNP | 3747168 | G | A |
| S_9427807 \| \| scaffold14851_3747570_SNP | 3747570 | A | G |
| S_9427825 \| \| scaffold14851_3747815_SNP | 3747815 | T | A |
| S_9427837 \| \| scaffold14851_3747908_SNP | 3747908 | A | C |
| S_9428204 \| \| scaffold14851_3752523_SNP | 3752523 | C | A |
| S_9428242 \| \| scaffold14851_3752998_SNP | 3752998 | A | G |
| S_9428580 \| \| scaffold14851_3756956_SNP | 3756956 | T | C |
| S_9428617 \| \| scaffold14851_3757250_SNP | 3757250 | T | C |
| S_9428618 \| \| scaffold14851_3757254_SNP | 3757254 | T | C |
| S_9428646 \| \| scaffold14851_3757624_SNP | 3757624 | A | T |
| S_9428647 \| \| scaffold14851_3757630_SNP | 3757630 | G | C |
| S_9428648 \| \| scaffold14851_3757643_SNP | 3757643 | A | T |
| S_9428650 \| \| scaffold14851_3757684_SNP | 3757684 | T | A |
| S_9428661 \| \| scaffold14851_3757882_SNP | 3757882 | C | A |
| S_9428665 \| \| scaffold14851_3757916_SNP | 3757916 | T | A |
| S_9428668 \| \| scaffold14851_3757967_SNP | 3757967 | C | G |
| S_9428677 \| \| scaffold14851_3758128_SNP | 3758128 | A | G |
| S_9428776 \| \| scaffold14851_3759435_SNP | 3759435 | T | G |
| S_9428798 \| \| scaffold14851_3759760_SNP | 3759760 | A | G |
| S_9428825 \| \| scaffold14851_3760210_SNP | 3760210 | C | T |
| S_9428873 \| \| scaffold14851_3760873_SNP | 3760873 | A | G |
| S_9428894 \| \| scaffold14851_3761207_SNP | 3761207 | T | G |
| S_9428996 \| \| scaffold14851_3762993_SNP | 3762993 | C | T |
| S_9429006 \| \| scaffold14851_3763077_SNP | 3763077 | A | T |
| S_9429118 \| \| scaffold14851_3764349_SNP | 3764349 | G | A |
| S_9429134 \| \| scaffold14851_3764791_SNP | 3764791 | C | T |
| S_9429141 \| \| scaffold14851_3764863_SNP | 3764863 | C | T |
| S_9429144 \| \| scaffold14851_3764925_SNP | 3764925 | C | T |
| S_9429161 \| \| scaffold14851_3765248_SNP | 3765248 | G | A |
| S_9429163 \| \| scaffold14851_3765277_SNP | 3765277 | C | G |
| S_9429284 \| \| scaffold14851_3766331_SNP | 3766331 | A | C |
| S_9429301 \| \| scaffold14851_3766557_SNP | 3766557 | T | A |
| S_9429340 \| \| scaffold14851_3766967_SNP | 3766967 | T | A |
| S_9429342 \| \| scaffold14851_3767014_SNP | 3767014 | T | A |
| S_9429354 \| \| scaffold14851_3767343_SNP | 3767343 | T | C |
| S_9429364 \| \| scaffold14851_3767707_SNP | 3767707 | C | T |
| S_9429438 \| \| scaffold14851_3768942_SNP | 3768942 | A | G |
| S_9429457 \| \| scaffold14851_3769347_SNP | 3769347 | T | C |
| S_9429464 \| \| scaffold14851_3769442_SNP | 3769442 | G | T |
| S_9429466 \| \| scaffold14851_3769446_SNP | 3769446 | T | G |
| S_9429471 \| \| scaffold14851_3769504_SNP | 3769504 | A | G |
| S_9429472 \| \| scaffold14851_3769544_SNP | 3769544 | T | C |
| S_9429476 \| \| scaffold14851_3769659_SNP | 3769659 | A | G |
| S_9429482 \| \| scaffold14851_3769729_SNP | 3769729 | C | G |
| S_9429490 \| \| scaffold14851_3769963_SNP | 3769963 | T | C |
| S_9429509 \| \| scaffold14851_3770186_SNP | 3770186 | G | A |
| S_9429511 \| \| scaffold14851_3770204_SNP | 3770204 | G | C |
| S_9429512 \| \| scaffold14851_3770248_SNP | 3770248 | G | A |
| S_9429523 \| \| scaffold14851_3770460_SNP | 3770460 | T | G |
| S_9429540 \| \| scaffold14851_3770759_SNP | 3770759 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9429676 \|\| scaffold14851_3773529_SNP | 3773529 | C | T |
| S_9429707 \|\| scaffold14851_3773775_SNP | 3773775 | C | G |
| S_9429714 \|\| scaffold14851_3773874_SNP | 3773874 | G | A |
| S_9429715 \|\| scaffold14851_3773875_SNP | 3773875 | G | A |
| S_9429722 \|\| scaffold14851_3773926_SNP | 3773926 | A | C |
| S_9429740 \|\| scaffold14851_3774122_SNP | 3774122 | T | G |
| S_9429762 \|\| scaffold14851_3774546_SNP | 3774546 | A | G |
| S_9429763 \|\| scaffold14851_3774563_SNP | 3774563 | T | A |
| S_9429764 \|\| scaffold14851_3774564_SNP | 3774564 | T | A |
| S_9429784 \|\| scaffold14851_3775137_SNP | 3775137 | G | A |
| S_9429809 \|\| scaffold14851_3775498_SNP | 3775498 | A | T |
| S_9429810 \|\| scaffold14851_3775500_SNP | 3775500 | T | C |
| S_9429817 \|\| scaffold14851_3775605_SNP | 3775605 | T | A |
| S_9429821 \|\| scaffold14851_3775819_SNP | 3775819 | G | T |
| S_9429847 \|\| scaffold14851_3776575_SNP | 3776575 | G | A |
| S_9429862 \|\| scaffold14851_3776859_SNP | 3776859 | A | G |
| S_9429961 \|\| scaffold14851_3777897_SNP | 3777897 | C | A |
| S_9429992 \|\| scaffold14851_3778211_SNP | 3778211 | C | A |
| S_9430065 \|\| scaffold14851_3779232_SNP | 3779232 | T | C |
| S_9430076 \|\| scaffold14851_3779370_SNP | 3779370 | T | C |
| S_9430105 \|\| scaffold14851_3779753_SNP | 3779753 | C | T |
| S_9430188 \|\| scaffold14851_3780507_SNP | 3780507 | T | A |
| S_9430192 \|\| scaffold14851_3780589_SNP | 3780589 | G | A |
| S_9430217 \|\| scaffold14851_3780864_SNP | 3780864 | C | A |
| S_9430340 \|\| scaffold14851_3782949_SNP | 3782949 | A | G |
| S_9430345 \|\| scaffold14851_3783004_SNP | 3783004 | C | T |
| S_9430350 \|\| scaffold14851_3783044_SNP | 3783044 | C | T |
| S_9430439 \|\| scaffold14851_3784334_SNP | 3784334 | T | C |
| S_9430440 \|\| scaffold14851_3784409_SNP | 3784409 | T | A |
| S_9430488 \|\| scaffold14851_3785090_SNP | 3785090 | C | G |
| S_9430499 \|\| scaffold14851_3785349_SNP | 3785349 | A | G |
| S_9430511 \|\| scaffold14851_3785719_SNP | 3785719 | A | G |
| S_9430513 \|\| scaffold14851_3785763_SNP | 3785763 | A | G |
| S_9430514 \|\| scaffold14851_3785786_SNP | 3785786 | T | C |
| S_9430574 \|\| scaffold14851_3786391_SNP | 3786391 | T | G |
| S_9430585 \|\| scaffold14851_3786620_SNP | 3786620 | C | G |
| S_9430594 \|\| scaffold14851_3786692_SNP | 3786692 | A | T |
| S_9430671 \|\| scaffold14851_3787532_SNP | 3787532 | G | A |
| S_9430672 \|\| scaffold14851_3787534_SNP | 3787534 | A | G |
| S_9430687 \|\| scaffold14851_3787744_SNP | 3787744 | T | G |
| S_9430697 \|\| scaffold14851_3787814_SNP | 3787814 | A | C |
| S_9430731 \|\| scaffold14851_3788224_SNP | 3788224 | T | A |
| S_9430741 \|\| scaffold14851_3788385_SNP | 3788385 | T | C |
| S_9430754 \|\| scaffold14851_3788652_SNP | 3788652 | T | C |
| S_9430874 \|\| scaffold14851_3789899_SNP | 3789899 | A | G |
| S_9430876 \|\| scaffold14851_3790020_SNP | 3790020 | T | A |
| S_9430878 \|\| scaffold14851_3790133_SNP | 3790133 | C | T |
| S_9430880 \|\| scaffold14851_3790153_SNP | 3790153 | G | T |
| S_9430883 \|\| scaffold14851_3790210_SNP | 3790210 | C | T |
| S_9430884 \|\| scaffold14851_3790242_SNP | 3790242 | C | G |
| S_9430893 \|\| scaffold14851_3790305_SNP | 3790305 | C | T |
| S_9430896 \|\| scaffold14851_3790363_SNP | 3790363 | T | C |
| S_9430900 \|\| scaffold14851_3790379_SNP | 3790379 | C | A |
| S_9430901 \|\| scaffold14851_3790384_SNP | 3790384 | C | A |
| S_9430956 \|\| scaffold14851_3791216_SNP | 3791216 | C | A |
| S_9431215 \|\| scaffold14851_3794761_SNP | 3794761 | T | A |
| S_9431285 \|\| scaffold14851_3795492_SNP | 3795492 | T | A |
| S_9431313 \|\| scaffold14851_3795946_SNP | 3795946 | T | C |
| S_9431324 \|\| scaffold14851_3796252_SNP | 3796252 | G | A |
| S_9431376 \|\| scaffold14851_3797262_SNP | 3797262 | T | A |
| S_9431504 \|\| scaffold14851_3798940_SNP | 3798940 | T | A |
| S_9431574 \|\| scaffold14851_3799942_SNP | 3799942 | G | A |
| S_9431575 \|\| scaffold14851_3799959_SNP | 3799959 | G | T |
| S_9431618 \|\| scaffold14851_3800571_SNP | 3800571 | A | T |
| S_9431655 \|\| scaffold14851_3801208_SNP | 3801208 | C | G |
| S_9431657 \|\| scaffold14851_3801288_SNP | 3801288 | C | T |
| S_9431660 \|\| scaffold14851_3801360_SNP | 3801360 | G | T |
| S_9431665 \|\| scaffold14851_3801550_SNP | 3801550 | G | T |
| S_9431763 \|\| scaffold14851_3802534_SNP | 3802534 | T | A |
| S_9431866 \|\| scaffold14851_3803201_SNP | 3803201 | A | G |
| S_9431938 \|\| scaffold14851_3803669_SNP | 3803669 | C | T |
| S_9431948 \|\| scaffold14851_3803832_SNP | 3803832 | C | A |
| S_9432027 \|\| scaffold14851_3804295_SNP | 3804295 | G | A |
| S_9432174 \|\| scaffold14851_3805541_SNP | 3805541 | T | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9432175 \| \| scaffold14851_3805558_SNP | 3805558 | A | T |
| S_9432179 \| \| scaffold14851_3805697_SNP | 3805697 | A | G |
| scaffold14851_3805858_SNP | 3805858 | G | A |
| S_9432197 \| \| scaffold14851_3805886_SNP | 3805886 | T | A |
| S_9432215 \| \| scaffold14851_3806079_SNP | 3806079 | C | T |
| S_9432216 \| \| scaffold14851_3806084_SNP | 3806084 | A | G |
| S_9432219 \| \| scaffold14851_3806137_SNP | 3806137 | G | T |
| S_9432229 \| \| scaffold14851_3806288_SNP | 3806288 | G | A |
| S_9432236 \| \| scaffold14851_3806344_SNP | 3806344 | T | A |
| S_9432238 \| \| scaffold14851_3806383_SNP | 3806383 | G | C |
| S_9432254 \| \| scaffold14851_3806655_SNP | 3806655 | A | G |
| S_9432257 \| \| scaffold14851_3806701_SNP | 3806701 | A | T |
| S_9432263 \| \| scaffold14851_3806802_SNP | 3806802 | C | T |
| S_9432313 \| \| scaffold14851_3807373_SNP | 3807373 | C | A |
| S_9432319 \| \| scaffold14851_3807389_SNP | 3807389 | A | T |
| S_9432341 \| \| scaffold14851_3807784_SNP | 3807784 | C | T |
| S_9432353 \| \| scaffold14851_3807924_SNP | 3807924 | A | T |
| S_9432358 \| \| scaffold14851_3808028_SNP | 3808028 | G | A |
| S_9432364 \| \| scaffold14851_3808181_SNP | 3808181 | A | C |
| S_9432365 \| \| scaffold14851_3808193_SNP | 3808193 | A | C |
| S_9432367 \| \| scaffold14851_3808201_SNP | 3808201 | T | A |
| S_9432368 \| \| scaffold14851_3808202_SNP | 3808202 | G | T |
| S_9432425 \| \| scaffold14851_3808902_SNP | 3808902 | G | T |
| S_9432438 \| \| scaffold14851_3809072_SNP | 3809072 | A | C |
| S_9432439 \| \| scaffold14851_3809073_SNP | 3809073 | C | T |
| S_9432446 \| \| scaffold14851_3809230_SNP | 3809230 | C | G |
| S_9432457 \| \| scaffold14851_3809448_SNP | 3809448 | A | T |
| S_9432459 \| \| scaffold14851_3809454_SNP | 3809454 | G | C |
| S_9432460 \| \| scaffold14851_3809456_SNP | 3809456 | G | A |
| S_9432466 \| \| scaffold14851_3809579_SNP | 3809579 | C | A |
| S_9432468 \| \| scaffold14851_3809601_SNP | 3809601 | T | C |
| S_9432477 \| \| scaffold14851_3809745_SNP | 3809745 | G | T |
| S_9432598 \| \| scaffold14851_3811146_SNP | 3811146 | G | A |
| S_9432652 \| \| scaffold14851_3811803_SNP | 3811803 | C | T |
| S_9432664 \| \| scaffold14851_3811913_SNP | 3811913 | G | T |
| S_9432701 \| \| scaffold14851_3812330_SNP | 3812330 | G | A |
| S_9432902 \| \| scaffold14851_3815064_SNP | 3815064 | T | A |
| S_9432936 \| \| scaffold14851_3815478_SNP | 3815478 | C | A |
| S_9432963 \| \| scaffold14851_3816139_SNP | 3816139 | T | C |
| S_9433151 \| \| scaffold14851_3817802_SNP | 3817802 | G | A |
| S_9433155 \| \| scaffold14851_3817863_SNP | 3817863 | C | A |
| S_9433161 \| \| scaffold14851_3818039_SNP | 3818039 | G | C |
| S_9433162 \| \| scaffold14851_3818059_SNP | 3818059 | C | G |
| S_9433167 \| \| scaffold14851_3818220_SNP | 3818220 | A | G |
| S_9433181 \| \| scaffold14851_3818432_SNP | 3818432 | G | A |
| S_9433183 \| \| scaffold14851_3818496_SNP | 3818496 | C | T |
| S_9433193 \| \| scaffold14851_3818619_SNP | 3818619 | G | A |
| S_9433197 \| \| scaffold14851_3818871_SNP | 3818871 | T | A |
| S_9433216 \| \| scaffold14851_3819166_SNP | 3819166 | G | C |
| S_9433227 \| \| scaffold14851_3819246_SNP | 3819246 | G | A |
| S_9433280 \| \| scaffold14851_3819788_SNP | 3819788 | A | G |
| S_9433323 \| \| scaffold14851_3820282_SNP | 3820282 | T | C |
| S_9433354 \| \| scaffold14851_3821086_SNP | 3821086 | G | T |
| S_9433398 \| \| scaffold14851_3821701_SNP | 3821701 | C | T |
| S_9433432 \| \| scaffold14851_3822331_SNP | 3822331 | G | T |
| S_9433477 \| \| scaffold14851_3822983_SNP | 3822983 | A | G |
| S_9433503 \| \| scaffold14851_3823329_SNP | 3823329 | A | G |
| S_9433511 \| \| scaffold14851_3823410_SNP | 3823410 | G | A |
| S_9433525 \| \| scaffold14851_3823500_SNP | 3823500 | C | T |
| S_9433610 \| \| scaffold14851_3824731_SNP | 3824731 | A | C |
| S_9433612 \| \| scaffold14851_3824781_SNP | 3824781 | G | C |
| S_9433620 \| \| scaffold14851_3824924_SNP | 3824924 | G | T |
| S_9433624 \| \| scaffold14851_3824993_SNP | 3824993 | T | G |
| S_9433633 \| \| scaffold14851_3825122_SNP | 3825122 | C | T |
| S_9433636 \| \| scaffold14851_3825153_SNP | 3825153 | T | C |
| S_9433664 \| \| scaffold14851_3825673_SNP | 3825673 | T | C |
| S_9433665 \| \| scaffold14851_3825693_SNP | 3825693 | T | C |
| S_9433759 \| \| scaffold14851_3827157_SNP | 3827157 | A | G |
| S_9434156 \| \| scaffold14851_3830437_SNP | 3830437 | C | G |
| S_9434260 \| \| scaffold14851_3831435_SNP | 3831435 | G | T |
| S_9434327 \| \| scaffold14851_3832561_SNP | 3832561 | T | A |
| S_9434358 \| \| scaffold14851_3832672_SNP | 3832672 | T | A |
| S_9434371 \| \| scaffold14851_3832714_SNP | 3832714 | C | A |
| S_9434395 \| \| scaffold14851_3833044_SNP | 3833044 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9434535 \| \| scaffold14851_3834801_SNP | 3834801 | A | T |
| scaffold14851_3834908_SNP | 3834908 | T | C |
| S_9434595 \| \| scaffold14851_3834945_SNP | 3834945 | A | T |
| S_9434828 \| \| scaffold14851_3837973_SNP | 3837973 | G | C |
| S_9434849 \| \| scaffold14851_3838052_SNP | 3838052 | A | G |
| S_9435340 \| \| scaffold14851_3842866_SNP | 3842866 | A | G |
| S_9435363 \| \| scaffold14851_3843093_SNP | 3843093 | C | T |
| S_9435492 \| \| scaffold14851_3844880_SNP | 3844880 | T | C |
| S_9435607 \| \| scaffold14851_3846458_SNP | 3846458 | C | A |
| S_9435608 \| \| scaffold14851_3846459_SNP | 3846459 | G | A |
| S_9435609 \| \| scaffold14851_3846460_SNP | 3846460 | A | G |
| S_9435610 \| \| scaffold14851_3846467_SNP | 3846467 | A | G |
| S_9435611 \| \| scaffold14851_3846469_SNP | 3846469 | A | G |
| S_9435627 \| \| scaffold14851_3846650_SNP | 3846650 | A | G |
| S_9435643 \| \| scaffold14851_3847162_SNP | 3847162 | A | G |
| S_9435685 \| \| scaffold14851_3847621_SNP | 3847621 | C | A |
| S_9435700 \| \| scaffold14851_3847823_SNP | 3847823 | C | G |
| S_9435708 \| \| scaffold14851_3847888_SNP | 3847888 | A | C |
| S_9435795 \| \| scaffold14851_3848925_SNP | 3848925 | G | A |
| S_9435796 \| \| scaffold14851_3848934_SNP | 3848934 | A | G |
| S_9435848 \| \| scaffold14851_3849684_SNP | 3849684 | A | G |
| S_9436190 \| \| scaffold14851_3854349_SNP | 3854349 | G | T |
| S_9436289 \| \| scaffold14851_3855095_SNP | 3855095 | G | A |
| S_9436406 \| \| scaffold14851_3856654_SNP | 3856654 | C | T |
| S_9436414 \| \| scaffold14851_3856730_SNP | 3856730 | A | G |
| S_9436417 \| \| scaffold14851_3856747_SNP | 3856747 | T | A |
| S_9436421 \| \| scaffold14851_3856786_SNP | 3856786 | G | T |
| S_9436428 \| \| scaffold14851_3856857_SNP | 3856857 | A | G |
| $_9436429 \| \| scaffold14851_3856862_SNP | 3856862 | C | T |
| S_9436519 \| \| scaffold14851_3858269_SNP | 3858269 | G | A |
| S_9436541 \| \| scaffold14851_3858565_SNP | 3858565 | G | T |
| S_9436558 \| \| scaffold14851_3858906_SNP | 3858906 | C | T |
| S_9436688 \| \| scaffold14851_3860162_SNP | 3860162 | T | A |
| S_9436811 \| \| scaffold14851_3861439_SNP | 3861439 | C | G |
| scaffold14851_3862050_SNP | 3862050 | G | A |
| S_9436909 \| \| scaffold14851_3863053_SNP | 3863053 | A | G |
| S_9436911 \| \| scaffold14851_3863100_SNP | 3863100 | G | C |
| S_9437081 \| \| scaffold14851_3865367_SNP | 3865367 | A | T |
| S_9437127 \| \| scaffold14851_3866044_SNP | 3866044 | A | G |
| S_9437154 \| \| scaffold14851_3866373_SNP | 3866373 | T | G |
| S_9437159 \| \| scaffold14851_3866423_SNP | 3866423 | T | C |
| S_9437161 \| \| scaffold14851_3866492_SNP | 3866492 | C | T |
| S_9437208 \| \| scaffold14851_3867187_SNP | 3867187 | T | G |
| S_9437209 \| \| scaffold14851_3867207_SNP | 3867207 | A | G |
| S_9437211 \| \| scaffold14851_3867259_SNP | 3867259 | T | C |
| S_9437282 \| \| scaffold14851_3868005_SNP | 3868005 | C | A |
| S_9437382 \| \| scaffold14851_3869103_SNP | 3869103 | T | C |
| S_9437393 \| \| scaffold14851_3869350_SNP | 3869350 | A | T |
| S_9437484 \| \| scaffold14851_3870594_SNP | 3870594 | C | T |
| S_9437552 \| \| scaffold14851_3871290_SNP | 3871290 | T | A |
| S_9437557 \| \| scaffold14851_3871365_SNP | 3871365 | T | C |
| S_9437567 \| \| scaffold14851_3871682_SNP | 3871682 | C | T |
| S_9437667 \| \| scaffold14851_3872695_SNP | 3872695 | C | T |
| S_9437671 \| \| scaffold14851_3872731_SNP | 3872731 | C | T |
| S_9437701 \| \| scaffold14851_3873156_SNP | 3873156 | A | T |
| S_9437702 \| \| scaffold14851_3873172_SNP | 3873172 | A | G |
| S_9437818 \| \| scaffold14851_3874593_SNP | 3874593 | A | G |
| S_9437819 \| \| scaffold14851_3874594_SNP | 3874594 | T | C |
| S_9437842 \| \| scaffold14851_3874979_SNP | 3874979 | G | T |
| S_9437852 \| \| scaffold14851_3875066_SNP | 3875066 | A | T |
| S_9437885 \| \| scaffold14851_3875700_SNP | 3875700 | G | T |
| S_9437888 \| \| scaffold14851_3875750_SNP | 3875750 | C | T |
| S_9437892 \| \| scaffold14851_3875766_SNP | 3875766 | T | C |
| S_9437894 \| \| scaffold14851_3875767_SNP | 3875767 | T | C |
| S_9437923 \| \| scaffold14851_3875943_SNP | 3875943 | A | C |
| S_9437927 \| \| scaffold14851_3875946_SNP | 3875946 | G | A |
| S_9437971 \| \| scaffold14851_3876206_SNP | 3876206 | C | T |
| S_9437974 \| \| scaffold14851_3876362_SNP | 3876362 | G | T |
| S_9437980 \| \| scaffold14851_3876410_SNP | 3876410 | T | C |
| S_9438052 \| \| scaffold14851_3877793_SNP | 3877793 | C | A |
| S_9438053 \| \| scaffold14851_3877794_SNP | 3877794 | C | T |
| S_9438065 \| \| scaffold14851_3878019_SNP | 3878019 | G | C |
| S_9438304 \| \| scaffold14851_3879971_SNP | 3879971 | G | C |
| S_9438334 \| \| scaffold14851_3880246_SNP | 3880246 | C | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9438384 \| \| scaffold14851_3880898_SNP | 3880898 | C | G |
| S_9438493 \| \| scaffold14851_3882471_SNP | 3882471 | T | C |
| S_9438494 \| \| scaffold14851_3882474_SNP | 3882474 | A | T |
| S_9438531 \| \| scaffold14851_3883064_SNP | 3883064 | C | T |
| S_9438555 \| \| scaffold14851_3883714_SNP | 3883714 | G | A |
| S_9438612 \| \| scaffold14851_3884020_SNP | 3884020 | A | G |
| S_9438666 \| \| scaffold14851_3885251_SNP | 3885251 | C | G |
| S_9438667 \| \| scaffold14851_3885291_SNP | 3885291 | A | C |
| S_9438685 \| \| scaffold14851_3885588_SNP | 3885588 | A | G |
| S_9438690 \| \| scaffold14851_3885662_SNP | 3885662 | G | A |
| S_9438745 \| \| scaffold14851_3886338_SNP | 3886338 | C | T |
| S_9438747 \| \| scaffold14851_3886405_SNP | 3886405 | G | A |
| S_9438777 \| \| scaffold14851_3886704_SNP | 3886704 | C | T |
| S_9438804 \| \| scaffold14851_3887355_SNP | 3887355 | G | A |
| S_9438815 \| \| scaffold14851_3887551_SNP | 3887551 | T | C |
| S_9438818 \| \| scaffold14851_3887574_SNP | 3887574 | C | G |
| S_9438851 \| \| scaffold14851_3887881_SNP | 3887881 | A | G |
| S_9438899 \| \| scaffold14851_3888317_SNP | 3888317 | T | C |
| S_9438973 \| \| scaffold14851_3889389_SNP | 3889389 | A | C |
| S_9439073 \| \| scaffold14851_3889634_SNP | 3889634 | G | T |
| S_9439076 \| \| scaffold14851_3889698_SNP | 3889698 | A | T |
| S_9439080 \| \| scaffold14851_3889729_SNP | 3889729 | C | T |
| S_9439082 \| \| scaffold14851_3889750_SNP | 3889750 | A | C |
| S_9439120 \| \| scaffold14851_3890282_SNP | 3890282 | A | T |
| S_9439160 \| \| scaffold14851_3890613_SNP | 3890613 | T | A |
| S_9439165 \| \| scaffold14851_3890660_SNP | 3890660 | A | G |
| S_9439235 \| \| scaffold14851_3891946_SNP | 3891946 | G | A |
| S_9439242 \| \| scaffold14851_3892003_SNP | 3892003 | G | A |
| S_9439267 \| \| scaffold14851_3892249_SNP | 3892249 | G | T |
| S_9439271 \| \| scaffold14851_3892309_SNP | 3892309 | G | T |
| S_9439274 \| \| scaffold14851_3892363_SNP | 3892363 | G | T |
| S_9439369 \| \| scaffold14851_3893415_SNP | 3893415 | C | A |
| S_9439377 \| \| scaffold14851_3893517_SNP | 3893517 | G | T |
| S_9439386 \| \| scaffold14851_3893669_SNP | 3893669 | A | G |
| S_9439396 \| \| scaffold14851_3893771_SNP | 3893771 | A | G |
| S_9439410 \| \| scaffold14851_3893891_SNP | 3893891 | A | C |
| S_9439490 \| \| scaffold14851_3894979_SNP | 3894979 | A | C |
| S_9439498 \| \| scaffold14851_3895180_SNP | 3895180 | G | T |
| S_9439534 \| \| scaffold14851_3895530_SNP | 3895530 | C | T |
| S_9439561 \| \| scaffold14851_3895950_SNP | 3895950 | T | A |
| S_9439582 \| \| scaffold14851_3896275_SNP | 3896275 | T | A |
| S_9439585 \| \| scaffold14851_3896318_SNP | 3896318 | A | G |
| S_9439685 \| \| scaffold14851_3897461_SNP | 3897461 | A | G |
| S_9439716 \| \| scaffold14851_3898003_SNP | 3898003 | C | A |
| S_9439718 \| \| scaffold14851_3898195_SNP | 3898195 | C | A |
| S_9439733 \| \| scaffold14851_3898363_SNP | 3898363 | T | A |
| S_9439740 \| \| scaffold14851_3898396_SNP | 3898396 | G | T |
| S_9439756 \| \| scaffold14851_3898639_SNP | 3898639 | C | A |
| S_9439768 \| \| scaffold14851_3898932_SNP | 3898932 | A | G |
| S_9439894 \| \| scaffold14851_3900128_SNP | 3900128 | T | C |
| S_9439929 \| \| scaffold14851_3900655_SNP | 3900655 | T | C |
| S_9439945 \| \| scaffold14851_3900890_SNP | 3900890 | C | G |
| S_9439961 \| \| scaffold14851_3901052_SNP | 3901052 | A | G |
| S_9439965 \| \| scaffold14851_3901134_SNP | 3901134 | A | G |
| S_9439969 \| \| scaffold14851_3901198_SNP | 3901198 | G | A |
| S_9440020 \| \| scaffold14851_3901690_SNP | 3901690 | T | G |
| S_9440060 \| \| scaffold14851_3902190_SNP | 3902190 | T | G |
| S_9440215 \| \| scaffold14851_3903781_SNP | 3903781 | C | G |
| S_9440292 \| \| scaffold14851_3904689_SNP | 3904689 | A | C |
| S_9440445 \| \| scaffold14851_3906317_SNP | 3906317 | A | T |
| S_9440447 \| \| scaffold14851_3906355_SNP | 3906355 | A | G |
| S_9440453 \| \| scaffold14851_3906421_SNP | 3906421 | T | C |
| S_9440494 \| \| scaffold14851_3907354_SNP | 3907354 | T | C |
| S_9440665 \| \| scaffold14851_3909216_SNP | 3909216 | T | C |
| S_9440672 \| \| scaffold14851_3909337_SNP | 3909337 | G | C |
| S_9440734 \| \| scaffold14851_3910144_SNP | 3910144 | A | G |
| S_9440735 \| \| scaffold14851_3910156_SNP | 3910156 | A | G |
| S_9440774 \| \| scaffold14851_3910450_SNP | 3910450 | A | T |
| S_9440805 \| \| scaffold14851_3910955_SNP | 3910955 | G | A |
| S_9440838 \| \| scaffold14851_3911360_SNP | 3911360 | A | G |
| S_9440842 \| \| scaffold14851_3911592_SNP | 3911592 | C | T |
| S_9440969 \| \| scaffold14851_3912581_SNP | 3912581 | T | A |
| S_9441033 \| \| scaffold14851_3913696_SNP | 3913696 | T | C |
| S_9441034 \| \| scaffold14851_3913790_SNP | 3913790 | A | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|------|------|------|------|
| S_9441035 \| \| scaffold14851_3913791_SNP | 3913791 | C | A |
| S_9441058 \| \| scaffold14851_3914071_SNP | 3914071 | C | T |
| S_9441062 \| \| scaffold14851_3914168_SNP | 3914168 | T | C |
| S_9441063 \| \| scaffold14851_3914171_SNP | 3914171 | T | A |
| S_9441064 \| \| scaffold14851_3914230_SNP | 3914230 | C | T |
| S_9441067 \| \| scaffold14851_3914266_SNP | 3914266 | T | A |
| S_9441069 \| \| scaffold14851_3914366_SNP | 3914366 | C | T |
| S_9441070 \| \| scaffold14851_3914367_SNP | 3914367 | A | G |
| S_9441080 \| \| scaffold14851_3914622_SNP | 3914622 | G | T |
| S_9441116 \| \| scaffold14851_3914947_SNP | 3914947 | A | G |
| S_9441124 \| \| scaffold14851_3915036_SNP | 3915036 | A | G |
| S_9441126 \| \| scaffold14851_3915042_SNP | 3915042 | C | T |
| S_9441155 \| \| scaffold14851_3915516_SNP | 3915516 | T | A |
| S_9441159 \| \| scaffold14851_3915525_SNP | 3915525 | G | A |
| S_9441161 \| \| scaffold14851_3915548_SNP | 3915548 | G | A |
| scaffold14851_3915599_SNP | 3915599 | C | T |
| scaffold14851_3915601_SNP | 3915601 | G | A |
| S_9441166 \| \| scaffold14851_3915620_SNP | 3915620 | G | A |
| S_9441167 \| \| scaffold14851_3915621_SNP | 3915621 | T | C |
| S_9441168 \| \| scaffold14851_3915643_SNP | 3915643 | A | C |
| S_9441180 \| \| scaffold14851_3915867_SNP | 3915867 | G | T |
| S_9441228 \| \| scaffold14851_3916483_SNP | 3916483 | A | G |
| S_9441282 \| \| scaffold14851_3917460_SNP | 3917460 | C | G |
| S_9441299 \| \| scaffold14851_3917648_SNP | 3917648 | T | C |
| S_9441305 \| \| scaffold14851_3917773_SNP | 3917773 | G | T |
| S_9441321 \| \| scaffold14851_3918076_SNP | 3918076 | A | C |
| S_9441361 \| \| scaffold14851_3918594_SNP | 3918594 | T | G |
| S_9441373 \| \| scaffold14851_3918711_SNP | 3918711 | C | A |
| S_9441378 \| \| scaffold14851_3918776_SNP | 3918776 | A | C |
| S_9441412 \| \| scaffold14851_3919049_SNP | 3919049 | T | C |
| S_9441417 \| \| scaffold14851_3919146_SNP | 3919146 | A | T |
| S_9441421 \| \| scaffold14851_3919215_SNP | 3919215 | G | T |
| S_9441423 \| \| scaffold14851_3919307_SNP | 3919307 | G | A |
| S_9441456 \| \| scaffold14851_3919650_SNP | 3919650 | A | C |
| S_9441457 \| \| scaffold14851_3919677_SNP | 3919677 | A | C |
| S_9441544 \| \| scaffold14851_3920328_SNP | 3920328 | G | A |
| scaffold14851_3920544_SNP | 3920544 | T | C |
| S_9441586 \| \| scaffold14851_3920709_SNP | 3920709 | A | G |
| S_9441587 \| \| scaffold14851_3920743_SNP | 3920743 | A | G |
| S_9441588 \| \| scaffold14851_3920753_SNP | 3920753 | G | A |
| S_9441590 \| \| scaffold14851_3920782_SNP | 3920782 | A | G |
| S_9441592 \| \| scaffold14851_3920807_SNP | 3920807 | T | C |
| scaffold14851_3921136_SNP | 3921136 | G | A |
| S_9441625 \| \| scaffold14851_3921251_SNP | 3921251 | C | T |
| S_9441627 \| \| scaffold14851_3921287_SNP | 3921287 | A | G |
| S_9441718 \| \| scaffold14851_3921636_SNP | 3921636 | C | G |
| S_9441782 \| \| scaffold14851_3922454_SNP | 3922454 | G | T |
| S_9441789 \| \| scaffold14851_3922582_SNP | 3922582 | T | G |
| S_9441829 \| \| scaffold14851_3923141_SNP | 3923141 | T | G |
| S_9441847 \| \| scaffold14851_3923416_SNP | 3923416 | G | A |
| S_9441858 \| \| scaffold14851_3923575_SNP | 3923575 | G | A |
| S_9441865 \| \| scaffold14851_3923650_SNP | 3923650 | G | A |
| S_9441886 \| \| scaffold14851_3923905_SNP | 3923905 | C | T |
| S_9441890 \| \| scaffold14851_3924036_SNP | 3924036 | C | G |
| S_9441929 \| \| scaffold14851_3924616_SNP | 3924616 | G | A |
| S_9441936 \| \| scaffold14851_3924697_SNP | 3924697 | A | G |
| S_9441952 \| \| scaffold14851_3924985_SNP | 3924985 | T | C |
| S_9441975 \| \| scaffold14851_3925352_SNP | 3925352 | C | T |
| S_9441994 \| \| scaffold14851_3925709_SNP | 3925709 | G | C |
| S_9441995 \| \| scaffold14851_3925720_SNP | 3925720 | T | C |
| scaffold14851_3927356_SNP | 3927356 | G | C |
| scaffold14851_3927357_SNP | 3927357 | T | G |
| S_9442090 \| \| scaffold14851_3927469_SNP | 3927469 | C | T |
| S_9442091 \| \| scaffold14851_3927480_SNP | 3927480 | T | C |
| S_9442096 \| \| scaffold14851_3927566_SNP | 3927566 | A | T |
| S_9442097 \| \| scaffold14851_3927587_SNP | 3927587 | C | T |
| S_9442100 \| \| scaffold14851_3927670_SNP | 3927670 | G | A |
| S_9442104 \| \| scaffold14851_3927815_SNP | 3927815 | A | T |
| S_9442106 \| \| scaffold14851_3927888_SNP | 3927888 | C | A |
| S_9442137 \| \| scaffold14851_3928430_SNP | 3928430 | G | A |
| S_9442138 \| \| scaffold14851_3928481_SNP | 3928481 | G | A |
| S_9442190 \| \| scaffold14851_3929132_SNP | 3929132 | A | C |
| S_9442227 \| \| scaffold14851_3930223_SNP | 3930223 | A | T |
| S_9442240 \| \| scaffold14851_3930449_SNP | 3930449 | G | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9442244 \| \| scaffold14851_3930508_SNP | 3930508 | A | G |
| S_9442245 \| \| scaffold14851_3930520_SNP | 3930520 | C | A |
| S_9442250 \| \| scaffold14851_3930572_SNP | 3930572 | A | T |
| S_9442286 \| \| scaffold14851_3931099_SNP | 3931099 | G | A |
| S_9442287 \| \| scaffold14851_3931101_SNP | 3931101 | T | C |
| S_9442289 \| \| scaffold14851_3931149_SNP | 3931149 | A | G |
| S_9442291 \| \| scaffold14851_3931160_SNP | 3931160 | T | G |
| S_9442306 \| \| scaffold14851_3931357_SNP | 3931357 | C | A |
| S_9442315 \| \| scaffold14851_3931492_SNP | 3931492 | A | T |
| S_9442322 \| \| scaffold14851_3931572_SNP | 3931572 | C | T |
| S_9442323 \| \| scaffold14851_3931583_SNP | 3931583 | A | G |
| S_9442371 \| \| scaffold14851_3931956_SNP | 3931956 | G | T |
| S_9442445 \| \| scaffold14851_3932621_SNP | 3932621 | A | C |
| S_9442448 \| \| scaffold14851_3932703_SNP | 3932703 | T | G |
| S_9442449 \| \| scaffold14851_3932708_SNP | 3932708 | C | A |
| S_9442495 \| \| scaffold14851_3933234_SNP | 3933234 | A | G |
| S_9442505 \| \| scaffold14851_3933346_SNP | 3933346 | C | T |
| S_9442515 \| \| scaffold14851_3933514_SNP | 3933514 | G | A |
| S_9442542 \| \| scaffold14851_3934211_SNP | 3934211 | G | C |
| S_9442547 \| \| scaffold14851_3934302_SNP | 3934302 | G | C |
| S_9442552 \| \| scaffold14851_3934388_SNP | 3934388 | G | T |
| S_9442562 \| \| scaffold14851_3934481_SNP | 3934481 | T | A |
| S_9442591 \| \| scaffold14851_3934845_SNP | 3934845 | C | G |
| S_9442635 \| \| scaffold14851_3935417_SNP | 3935417 | C | T |
| S_9442639 \| \| scaffold14851_3935465_SNP | 3935465 | C | T |
| S_9442648 \| \| scaffold14851_3935570_SNP | 3935570 | T | C |
| S_9442688 \| \| scaffold14851_3935864_SNP | 3935864 | C | A |
| S_9442689 \| \| scaffold14851_3935867_SNP | 3935867 | G | A |
| S_9442718 \| \| scaffold14851_3936490_SNP | 3936490 | A | G |
| S_9442739 \| \| scaffold14851_3937075_SNP | 3937075 | A | G |
| S_9442745 \| \| scaffold14851_3937209_SNP | 3937209 | A | C |
| S_9442749 \| \| scaffold14851_3937313_SNP | 3937313 | C | T |
| S_9442763 \| \| scaffold14851_3937495_SNP | 3937495 | C | G |
| S_9442765 \| \| scaffold14851_3937502_SNP | 3937502 | A | G |
| S_9442830 \| \| scaffold14851_3938447_SNP | 3938447 | T | A |
| S_9442845 \| \| scaffold14851_3938586_SNP | 3938586 | G | C |
| S_9442849 \| \| scaffold14851_3938624_SNP | 3938624 | A | T |
| S_9442893 \| \| scaffold14851_3939404_SNP | 3939404 | T | A |
| S_9442906 \| \| scaffold14851_3939562_SNP | 3939562 | G | C |
| S_9443019 \| \| scaffold14851_3940470_SNP | 3940470 | G | A |
| S_9443043 \| \| scaffold14851_3940629_SNP | 3940629 | T | A |
| S_9443070 \| \| scaffold14851_3940910_SNP | 3940910 | G | A |
| S_9443073 \| \| scaffold14851_3940927_SNP | 3940927 | T | G |
| S_9443078 \| \| scaffold14851_3941000_SNP | 3941000 | T | C |
| S_9443079 \| \| scaffold14851_3941022_SNP | 3941022 | T | C |
| S_9443091 \| \| scaffold14851_3941195_SNP | 3941195 | T | C |
| S_9443092 \| \| scaffold14851_3941197_SNP | 3941197 | T | C |
| S_9443220 \| \| scaffold14851_3943645_SNP | 3943645 | A | G |
| S_9443226 \| \| scaffold14851_3943680_SNP | 3943680 | C | G |
| S_9443258 \| \| scaffold14851_3944232_SNP | 3944232 | T | A |
| S_9443269 \| \| scaffold14851_3944368_SNP | 3944368 | T | A |
| S_9443275 \| \| scaffold14851_3944423_SNP | 3944423 | C | T |
| S_9443282 \| \| scaffold14851_3944493_SNP | 3944493 | A | T |
| S_9443319 \| \| scaffold14851_3944979_SNP | 3944979 | A | G |
| S_9443341 \| \| scaffold14851_3945464_SNP | 3945464 | A | G |
| S_9443348 \| \| scaffold14851_3945643_SNP | 3945643 | A | G |
| S_9443383 \| \| scaffold14851_3946168_SNP | 3946168 | G | A |
| S_9443385 \| \| scaffold14851_3946173_SNP | 3946173 | G | A |
| S_9443386 \| \| scaffold14851_3946174_SNP | 3946174 | G | A |
| S_9443409 \| \| scaffold14851_3946590_SNP | 3946590 | A | G |
| S_9443566 \| \| scaffold14851_3947892_SNP | 3947892 | A | C |
| S_9443581 \| \| scaffold14851_3948027_SNP | 3948027 | C | T |
| S_9443608 \| \| scaffold14851_3948366_SNP | 3948366 | T | C |
| S_9443772 \| \| scaffold14851_3950622_SNP | 3950622 | C | T |
| S_9443978 \| \| scaffold14851_3952609_SNP | 3952609 | T | C |
| S_9444217 \| \| scaffold14851_3955988_SNP | 3955988 | G | T |
| S_9444285 \| \| scaffold14851_3956892_SNP | 3956892 | C | T |
| S_9444286 \| \| scaffold14851_3956893_SNP | 3956893 | T | G |
| S_9444329 \| \| scaffold14851_3957391_SNP | 3957391 | A | T |
| S_9444540 \| \| scaffold14851_3960500_SNP | 3960500 | T | C |
| S_9444583 \| \| scaffold14851_3961096_SNP | 3961096 | T | C |
| S_9444702 \| \| scaffold14851_3962731_SNP | 3962731 | A | C |
| S_9444749 \| \| scaffold14851_3963295_SNP | 3963295 | A | G |
| S_9444869 \| \| scaffold14851_3964584_SNP | 3964584 | C | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9444874 \| \| scaffold14851_3964781_SNP | 3964781 | T | A |
| S_9444878 \| \| scaffold14851_3964865_SNP | 3964865 | A | C |
| S_9444884 \| \| scaffold14851_3965021_SNP | 3965021 | C | T |
| S_9444887 \| \| scaffold14851_3965098_SNP | 3965098 | C | A |
| S_9444889 \| \| scaffold14851_3965108_SNP | 3965108 | A | T |
| S_9444891 \| \| scaffold14851_3965182_SNP | 3965182 | T | G |
| S_9444893 \| \| scaffold14851_3965215_SNP | 3965215 | G | A |
| S_9444894 \| \| scaffold14851_3965231_SNP | 3965231 | T | C |
| S_9444895 \| \| scaffold14851_3965238_SNP | 3965238 | G | A |
| S_9444903 \| \| scaffold14851_3965361_SNP | 3965361 | G | C |
| S_9444915 \| \| scaffold14851_3965482_SNP | 3965482 | A | T |
| S_9444937 \| \| scaffold14851_3965774_SNP | 3965774 | C | G |
| S_9444962 \| \| scaffold14851_3966452_SNP | 3966452 | G | C |
| S_9445026 \| \| scaffold14851_3967129_SNP | 3967129 | C | T |
| S_9445134 \| \| scaffold14851_3968512_SNP | 3968512 | A | C |
| S_9445144 \| \| scaffold14851_3968749_SNP | 3968749 | G | A |
| S_9445203 \| \| scaffold14851_3969466_SNP | 3969466 | G | A |
| S_9445216 \| \| scaffold14851_3969693_SNP | 3969693 | G | A |
| S_9445224 \| \| scaffold14851_3969834_SNP | 3969834 | A | C |
| S_9445236 \| \| scaffold14851_3969918_SNP | 3969918 | G | C |
| S_9445418 \| \| scaffold14851_3972549_SNP | 3972549 | C | T |
| S_9445481 \| \| scaffold14851_3973389_SNP | 3973389 | C | T |
| S_9445503 \| \| scaffold14851_3973710_SNP | 3973710 | T | C |
| S_9445541 \| \| scaffold14851_3974232_SNP | 3974232 | T | C |
| S_9445542 \| \| scaffold14851_3974250_SNP | 3974250 | G | A |
| S_9445543 \| \| scaffold14851_3974313_SNP | 3974313 | A | G |
| S_9445557 \| \| scaffold14851_3974531_SNP | 3974531 | T | G |
| S_9445566 \| \| scaffold14851_3974750_SNP | 3974750 | T | A |
| S_9445615 \| \| scaffold14851_3975538_SNP | 3975538 | A | G |
| S_9445775 \| \| scaffold14851_3978035_SNP | 3978035 | G | T |
| S_9445858 \| \| scaffold14851_3978912_SNP | 3978912 | A | C |
| S_9445864 \| \| scaffold14851_3978961_SNP | 3978961 | C | G |
| S_9445957 \| \| scaffold14851_3980102_SNP | 3980102 | G | A |
| S_9446000 \| \| scaffold14851_3980612_SNP | 3980612 | C | T |
| S_9446001 \| \| scaffold14851_3980647_SNP | 3980647 | G | A |
| S_9446013 \| \| scaffold14851_3980872_SNP | 3980872 | C | G |
| S_9446014 \| \| scaffold14851_3980887_SNP | 3980887 | C | G |
| S_9446103 \| \| scaffold14851_3981904_SNP | 3981904 | C | G |
| S_9446104 \| \| scaffold14851_3981943_SNP | 3981943 | G | C |
| S_9446142 \| \| scaffold14851_3982800_SNP | 3982800 | A | G |
| S_9446154 \| \| scaffold14851_3982873_SNP | 3982873 | C | G |
| S_9446156 \| \| scaffold14851_3982949_SNP | 3982949 | A | G |
| S_9446163 \| \| scaffold14851_3983023_SNP | 3983023 | C | G |
| S_9446175 \| \| scaffold14851_3983216_SNP | 3983216 | T | G |
| S_9446205 \| \| scaffold14851_3983858_SNP | 3983858 | A | T |
| S_9446207 \| \| scaffold14851_3983924_SNP | 3983924 | C | T |
| S_9446213 \| \| scaffold14851_3984121_SNP | 3984121 | C | T |
| S_9446217 \| \| scaffold14851_3984287_SNP | 3984287 | A | T |
| S_9446218 \| \| scaffold14851_3984289_SNP | 3984289 | A | C |
| S_9446220 \| \| scaffold14851_3984294_SNP | 3984294 | T | C |
| S_9446230 \| \| scaffold14851_3984447_SNP | 3984447 | G | A |
| S_9446246 \| \| scaffold14851_3984775_SNP | 3984775 | C | G |
| S_9446270 \| \| scaffold14851_3985135_SNP | 3985135 | A | C |
| S_9446287 \| \| scaffold14851_3985156_SNP | 3985156 | A | T |
| S_9446298 \| \| scaffold14851_3985173_SNP | 3985173 | C | T |
| S_9446313 \| \| scaffold14851_3985261_SNP | 3985261 | G | A |
| S_9446315 \| \| scaffold14851_3985267_SNP | 3985267 | A | G |
| S_9446332 \| \| scaffold14851_3985488_SNP | 3985488 | G | A |
| S_9446398 \| \| scaffold14851_3985938_SNP | 3985938 | C | T |
| S_9446438 \| \| scaffold14851_3986124_SNP | 3986124 | C | G |
| S_9446557 \| \| scaffold14851_3987841_SNP | 3987841 | C | G |
| S_9446560 \| \| scaffold14851_3987886_SNP | 3987886 | A | T |
| S_9446576 \| \| scaffold14851_3988078_SNP | 3988078 | T | C |
| S_9446595 \| \| scaffold14851_3988369_SNP | 3988369 | T | A |
| S_9446605 \| \| scaffold14851_3988522_SNP | 3988522 | C | A |
| S_9446666 \| \| scaffold14851_3988690_SNP | 3988690 | T | A |
| S_9446671 \| \| scaffold14851_3988738_SNP | 3988738 | C | T |
| S_9446673 \| \| scaffold14851_3988782_SNP | 3988782 | G | A |
| S_9446683 \| \| scaffold14851_3988928_SNP | 3988928 | T | A |
| S_9446690 \| \| scaffold14851_3988999_SNP | 3988999 | A | G |
| S_9446711 \| \| scaffold14851_3989427_SNP | 3989427 | C | T |
| S_9446716 \| \| scaffold14851_3989574_SNP | 3989574 | A | T |
| S_9446727 \| \| scaffold14851_3989801_SNP | 3989801 | A | C |
| S_9446757 \| \| scaffold14851_3990348_SNP | 3990348 | C | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9446758 \| \| scaffold14851_3990357_SNP | 3990357 | T | A |
| S_9446761 \| \| scaffold14851_3990444_SNP | 3990444 | A | G |
| S_9446762 \| \| scaffold14851_3990449_SNP | 3990449 | A | G |
| S_9446763 \| \| scaffold14851_3990450_SNP | 3990450 | T | A |
| S_9446818 \| \| scaffold14851_3991162_SNP | 3991162 | C | T |
| S_9446828 \| \| scaffold14851_3991420_SNP | 3991420 | C | A |
| S_9446830 \| \| scaffold14851_3991423_SNP | 3991423 | C | A |
| S_9446848 \| \| scaffold14851_3991601_SNP | 3991601 | T | A |
| S_9446874 \| \| scaffold14851_3992101_SNP | 3992101 | C | T |
| S_9446895 \| \| scaffold14851_3992375_SNP | 3992375 | A | G |
| S_9446899 \| \| scaffold14851_3992386_SNP | 3992386 | T | C |
| S_9446901 \| \| scaffold14851_3992393_SNP | 3992393 | T | C |
| S_9446911 \| \| scaffold14851_3992508_SNP | 3992508 | A | G |
| S_9446917 \| \| scaffold14851_3992547_SNP | 3992547 | G | A |
| S_9446940 \| \| scaffold14851_3992696_SNP | 3992696 | A | G |
| S_9446947 \| \| scaffold14851_3992792_SNP | 3992792 | A | C |
| S_9446952 \| \| scaffold14851_3992866_SNP | 3992866 | T | C |
| S_9446954 \| \| scaffold14851_3992877_SNP | 3992877 | G | A |
| S_9447057 \| \| scaffold14851_3993420_SNP | 3993420 | C | T |
| S_9447070 \| \| scaffold14851_3993627_SNP | 3993627 | T | C |
| S_9447111 \| \| scaffold14851_3994360_SNP | 3994360 | G | A |
| S_9447116 \| \| scaffold14851_3994421_SNP | 3994421 | A | G |
| S_9447120 \| \| scaffold14851_3994439_SNP | 3994439 | G | A |
| S_9447127 \| \| scaffold14851_3994623_SNP | 3994623 | T | A |
| S_9447129 \| \| scaffold14851_3994652_SNP | 3994652 | G | A |
| S_9447206 \| \| scaffold14851_3994948_SNP | 3994948 | G | A |
| S_9447209 \| \| scaffold14851_3995010_SNP | 3995010 | C | G |
| S_9447214 \| \| scaffold14851_3995107_SNP | 3995107 | G | A |
| S_9447232 \| \| scaffold14851_3995273_SNP | 3995273 | C | A |
| S_9447235 \| \| scaffold14851_3995287_SNP | 3995287 | A | T |
| S_9447272 \| \| scaffold14851_3995759_SNP | 3995759 | G | C |
| S_9447277 \| \| scaffold14851_3995815_SNP | 3995815 | G | T |
| S_9447302 \| \| scaffold14851_3996121_SNP | 3996121 | T | A |
| S_9447309 \| \| scaffold14851_3996248_SNP | 3996248 | G | A |
| S_9447310 \| \| scaffold14851_3996255_SNP | 3996255 | T | A |
| S_9447313 \| \| scaffold14851_3996271_SNP | 3996271 | C | T |
| S_9447331 \| \| scaffold14851_3996348_SNP | 3996348 | A | G |
| S_9447396 \| \| scaffold14851_3996697_SNP | 3996697 | A | G |
| S_9447398 \| \| scaffold14851_3996704_SNP | 3996704 | A | C |
| S_9447461 \| \| scaffold14851_3997299_SNP | 3997299 | A | T |
| S_9447462 \| \| scaffold14851_3997309_SNP | 3997309 | T | C |
| S_9447463 \| \| scaffold14851_3997311_SNP | 3997311 | A | C |
| S_9447464 \| \| scaffold14851_3997325_SNP | 3997325 | A | G |
| S_9447465 \| \| scaffold14851_3997333_SNP | 3997333 | T | A |
| S_9447466 \| \| scaffold14851_3997336_SNP | 3997336 | T | C |
| S_9447467 \| \| scaffold14851_3997395_SNP | 3997395 | G | T |
| S_9447468 \| \| scaffold14851_3997403_SNP | 3997403 | A | G |
| S_9447477 \| \| scaffold14851_3997620_SNP | 3997620 | A | G |
| S_9447478 \| \| scaffold14851_3997628_SNP | 3997628 | G | A |
| S_9447479 \| \| scaffold14851_3997649_SNP | 3997649 | T | C |
| S_9447530 \| \| scaffold14851_3998090_SNP | 3998090 | C | A |
| S_9447542 \| \| scaffold14851_3998202_SNP | 3998202 | C | T |
| S_9447546 \| \| scaffold14851_3998269_SNP | 3998269 | A | G |
| S_9447584 \| \| scaffold14851_3998569_SNP | 3998569 | T | C |
| S_9447586 \| \| scaffold14851_3998590_SNP | 3998590 | T | A |
| S_9447692 \| \| scaffold14851_3999874_SNP | 3999874 | T | C |
| S_9447706 \| \| scaffold14851_3999896_SNP | 3999896 | A | G |
| S_9447712 \| \| scaffold14851_3999901_SNP | 3999901 | T | A |
| S_9447752 \| \| scaffold14851_4000184_SNP | 4000184 | A | T |
| S_9447753 \| \| scaffold14851_4000188_SNP | 4000188 | G | T |
| S_9447754 \| \| scaffold14851_4000198_SNP | 4000198 | A | G |
| S_9447762 \| \| scaffold14851_4000271_SNP | 4000271 | C | T |
| S_9447818 \| \| scaffold14851_4000887_SNP | 4000887 | G | T |
| S_9447844 \| \| scaffold14851_4001095_SNP | 4001095 | A | G |
| S_9447882 \| \| scaffold14851_4001331_SNP | 4001331 | C | G |
| S_9447884 \| \| scaffold14851_4001362_SNP | 4001362 | C | G |
| S_9447957 \| \| scaffold14851_4002700_SNP | 4002700 | A | G |
| S_9447989 \| \| scaffold14851_4003147_SNP | 4003147 | G | C |
| S_9447991 \| \| scaffold14851_4003173_SNP | 4003173 | A | T |
| S_9448008 \| \| scaffold14851_4003426_SNP | 4003426 | G | A |
| S_9448009 \| \| scaffold14851_4003433_SNP | 4003433 | C | A |
| S_9448035 \| \| scaffold14851_4003662_SNP | 4003662 | G | A |
| S_9448044 \| \| scaffold14851_4003743_SNP | 4003743 | A | G |
| S_9448045 \| \| scaffold14851_4003771_SNP | 4003771 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9448047 \| \| scaffold14851_4003796_SNP | 4003796 | G | T |
| S_9448048 \| \| scaffold14851_4003802_SNP | 4003802 | C | A |
| S_9448063 \| \| scaffold14851_4004012_SNP | 4004012 | G | C |
| S_9448067 \| \| scaffold14851_4004028_SNP | 4004028 | T | A |
| S_9448075 \| \| scaffold14851_4004095_SNP | 4004095 | C | G |
| S_9448087 \| \| scaffold14851_4004288_SNP | 4004288 | T | C |
| S_9448089 \| \| scaffold14851_4004293_SNP | 4004293 | T | C |
| S_9448098 \| \| scaffold14851_4004419_SNP | 4004419 | T | C |
| S_9448125 \| \| scaffold14851_4004827_SNP | 4004827 | A | G |
| S_9448149 \| \| scaffold14851_4005027_SNP | 4005027 | G | T |
| S_9448162 \| \| scaffold14851_4005129_SNP | 4005129 | T | A |
| S_9448163 \| \| scaffold14851_4005135_SNP | 4005135 | G | T |
| S_9448164 \| \| scaffold14851_4005140_SNP | 4005140 | A | T |
| S_9448165 \| \| scaffold14851_4005149_SNP | 4005149 | A | C |
| S_9448174 \| \| scaffold14851_4005269_SNP | 4005269 | A | G |
| S_9448195 \| \| scaffold14851_4005484_SNP | 4005484 | A | T |
| S_9448206 \| \| scaffold14851_4005636_SNP | 4005636 | A | G |
| S_9448293 \| \| scaffold14851_4006840_SNP | 4006840 | G | A |
| S_9448307 \| \| scaffold14851_4007057_SNP | 4007057 | C | A |
| S_9448382 \| \| scaffold14851_4007853_SNP | 4007853 | A | G |
| S_9448405 \| \| scaffold14851_4007997_SNP | 4007997 | C | T |
| S_9448409 \| \| scaffold14851_4008052_SNP | 4008052 | T | C |
| S_9448436 \| \| scaffold14851_4008369_SNP | 4008369 | T | A |
| S_9448455 \| \| scaffold14851_4008762_SNP | 4008762 | A | C |
| S_9448458 \| \| scaffold14851_4008786_SNP | 4008786 | T | G |
| S_9448460 \| \| scaffold14851_4008795_SNP | 4008795 | C | T |
| S_9448462 \| \| scaffold14851_4008822_SNP | 4008822 | G | A |
| S_9448464 \| \| scaffold14851_4008844_SNP | 4008844 | C | A |
| S_9448471 \| \| scaffold14851_4009011_SNP | 4009011 | G | C |
| S_9448588 \| \| scaffold14851_4010021_SNP | 4010021 | C | A |
| S_9448603 \| \| scaffold14851_4010512_SNP | 4010512 | A | G |
| S_9448604 \| \| scaffold14851_4010514_SNP | 4010514 | G | A |
| S_9448607 \| \| scaffold14851_4010536_SNP | 4010536 | A | G |
| S_9448621 \| \| scaffold14851_4010704_SNP | 4010704 | A | T |
| S_9448648 \| \| scaffold14851_4011351_SNP | 4011351 | A | T |
| S_9448692 \| \| scaffold14851_4011922_SNP | 4011922 | A | C |
| S_9448743 \| \| scaffold14851_4012651_SNP | 4012651 | G | C |
| S_9448770 \| \| scaffold14851_4012965_SNP | 4012965 | A | C |
| S_9448780 \| \| scaffold14851_4013090_SNP | 4013090 | G | A |
| S_9448803 \| \| scaffold14851_4013506_SNP | 4013506 | A | T |
| S_9448821 \| \| scaffold14851_4013766_SNP | 4013766 | T | G |
| S_9448822 \| \| scaffold14851_4013773_SNP | 4013773 | G | C |
| S_9448868 \| \| scaffold14851_4014261_SNP | 4014261 | A | C |
| S_9448871 \| \| scaffold14851_4014281_SNP | 4014281 | G | T |
| S_9448902 \| \| scaffold14851_4014602_SNP | 4014602 | T | A |
| S_9449475 \| \| scaffold14851_4019761_SNP | 4019761 | T | A |
| S_9449494 \| \| scaffold14851_4019964_SNP | 4019964 | G | C |
| S_9449526 \| \| scaffold14851_4020360_SNP | 4020360 | G | A |
| S_9449544 \| \| scaffold14851_4020591_SNP | 4020591 | C | T |
| S_9449589 \| \| scaffold14851_4021278_SNP | 4021278 | G | C |
| S_9449647 \| \| scaffold14851_4022323_SNP | 4022323 | C | T |
| S_9449651 \| \| scaffold14851_4022494_SNP | 4022494 | C | T |
| S_9449667 \| \| scaffold14851_4022814_SNP | 4022814 | A | T |
| S_9449722 \| \| scaffold14851_4023608_SNP | 4023608 | T | A |
| S_9449764 \| \| scaffold14851_4024622_SNP | 4024622 | T | G |
| S_9449778 \| \| scaffold14851_4024913_SNP | 4024913 | G | T |
| S_9449787 \| \| scaffold14851_4025090_SNP | 4025090 | G | A |
| S_9449816 \| \| scaffold14851_4025476_SNP | 4025476 | G | T |
| S_9449817 \| \| scaffold14851_4025478_SNP | 4025478 | T | G |
| S_9449831 \| \| scaffold14851_4025730_SNP | 4025730 | T | C |
| S_9449834 \| \| scaffold14851_4025800_SNP | 4025800 | A | G |
| S_9449835 \| \| scaffold14851_4025832_SNP | 4025832 | A | C |
| S_9449836 \| \| scaffold14851_4025839_SNP | 4025839 | T | G |
| S_9449842 \| \| scaffold14851_4025903_SNP | 4025903 | T | C |
| S_9449843 \| \| scaffold14851_4025919_SNP | 4025919 | A | G |
| S_9449847 \| \| scaffold14851_4025998_SNP | 4025998 | A | T |
| S_9449939 \| \| scaffold14851_4027080_SNP | 4027080 | C | T |
| S_9449949 \| \| scaffold14851_4027152_SNP | 4027152 | A | G |
| S_9449972 \| \| scaffold14851_4027482_SNP | 4027482 | T | C |
| S_9450017 \| \| scaffold14851_4027855_SNP | 4027855 | C | G |
| S_9450024 \| \| scaffold14851_4027907_SNP | 4027907 | A | G |
| S_9450027 \| \| scaffold14851_4027971_SNP | 4027971 | G | A |
| S_9450075 \| \| scaffold14851_4028401_SNP | 4028401 | A | G |
| S_9450200 \| \| scaffold14851_4029280_SNP | 4029280 | T | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9450229 \| \| scaffold14851_4029418_SNP | 4029418 | G | A |
| S_9450268 \| \| scaffold14851_4030182_SNP | 4030182 | C | A |
| scaffold14851_4031047_SNP | 4031047 | T | G |
| scaffold14851_4031733_SNP | 4031733 | A | G |
| S_9450706 \| \| scaffold14851_4032000_SNP | 4032000 | A | G |
| S_9450711 \| \| scaffold14851_4032033_SNP | 4032033 | G | A |
| S_9450716 \| \| scaffold14851_4032091_SNP | 4032091 | G | A |
| S_9450717 \| \| scaffold14851_4032097_SNP | 4032097 | G | A |
| S_9450730 \| \| scaffold14851_4032278_SNP | 4032278 | A | G |
| S_9450734 \| \| scaffold14851_4032340_SNP | 4032340 | T | C |
| S_9450738 \| \| scaffold14851_4032398_SNP | 4032398 | A | G |
| S_9450744 \| \| scaffold14851_4032442_SNP | 4032442 | C | T |
| S_9450760 \| \| scaffold14851_4032647_SNP | 4032647 | G | T |
| S_9450762 \| \| scaffold14851_4032696_SNP | 4032696 | T | C |
| S_9450777 \| \| scaffold14851_4032954_SNP | 4032954 | T | C |
| S_9450779 \| \| scaffold14851_4032997_SNP | 4032997 | T | C |
| S_9450794 \| \| scaffold14851_4033196_SNP | 4033196 | G | C |
| S_9450818 \| \| scaffold14851_4033651_SNP | 4033651 | G | C |
| S_9450838 \| \| scaffold14851_4033818_SNP | 4033818 | C | T |
| S_9450897 \| \| scaffold14851_4034601_SNP | 4034601 | G | A |
| S_9450905 \| \| scaffold14851_4034753_SNP | 4034753 | A | G |
| S_9450907 \| \| scaffold14851_4034782_SNP | 4034782 | T | A |
| S_9450923 \| \| scaffold14851_4035111_SNP | 4035111 | G | T |
| S_9450926 \| \| scaffold14851_4035162_SNP | 4035162 | G | C |
| S_9450934 \| \| scaffold14851_4035246_SNP | 4035246 | G | A |
| S_9451014 \| \| scaffold14851_4036593_SNP | 4036593 | A | C |
| S_9451047 \| \| scaffold14851_4037190_SNP | 4037190 | T | G |
| S_9451051 \| \| scaffold14851_4037269_SNP | 4037269 | G | T |
| S_9451053 \| \| scaffold14851_4037318_SNP | 4037318 | A | G |
| S_9451055 \| \| scaffold14851_4037387_SNP | 4037387 | G | T |
| S_9451106 \| \| scaffold14851_4038097_SNP | 4038097 | T | C |
| S_9451127 \| \| scaffold14851_4038316_SNP | 4038316 | C | T |
| S_9451160 \| \| scaffold14851_4038748_SNP | 4038748 | G | A |
| S_9451161 \| \| scaffold14851_4038780_SNP | 4038780 | A | T |
| S_9451164 \| \| scaffold14851_4038828_SNP | 4038828 | T | C |
| S_9451190 \| \| scaffold14851_4039067_SNP | 4039067 | C | T |
| S_9451201 \| \| scaffold14851_4039257_SNP | 4039257 | A | T |
| S_9451202 \| \| scaffold14851_4039258_SNP | 4039258 | T | C |
| S_9451236 \| \| scaffold14851_4039568_SNP | 4039568 | T | A |
| S_9451255 \| \| scaffold14851_4039927_SNP | 4039927 | G | A |
| S_9451295 \| \| scaffold14851_4040364_SNP | 4040364 | G | A |
| S_9451296 \| \| scaffold14851_4040370_SNP | 4040370 | T | G |
| S_9451320 \| \| scaffold14851_4040688_SNP | 4040688 | T | C |
| S_9451402 \| \| scaffold14851_4041578_SNP | 4041578 | C | A |
| S_9451479 \| \| scaffold14851_4042581_SNP | 4042581 | C | A |
| S_9451480 \| \| scaffold14851_4042584_SNP | 4042584 | C | G |
| S_9451481 \| \| scaffold14851_4042616_SNP | 4042616 | A | G |
| S_9451484 \| \| scaffold14851_4042654_SNP | 4042654 | T | G |
| S_9451809 \| \| scaffold14851_4045294_SNP | 4045294 | G | T |
| S_9451825 \| \| scaffold14851_4045641_SNP | 4045641 | A | G |
| S_9451829 \| \| scaffold14851_4045798_SNP | 4045798 | A | T |
| S_9451833 \| \| scaffold14851_4045937_SNP | 4045937 | C | T |
| S_9451839 \| \| scaffold14851_4046072_SNP | 4046072 | A | G |
| S_9451852 \| \| scaffold14851_4046313_SNP | 4046313 | G | C |
| S_9451869 \| \| scaffold14851_4046668_SNP | 4046668 | A | G |
| S_9451871 \| \| scaffold14851_4046680_SNP | 4046680 | G | C |
| S_9451906 \| \| scaffold14851_4047162_SNP | 4047162 | T | C |
| S_9451913 \| \| scaffold14851_4047332_SNP | 4047332 | T | C |
| S_9451930 \| \| scaffold14851_4047669_SNP | 4047669 | T | A |
| S_9451932 \| \| scaffold14851_4047712_SNP | 4047712 | G | A |
| S_9452017 \| \| scaffold14851_4048616_SNP | 4048616 | G | T |
| S_9452098 \| \| scaffold14851_4049819_SNP | 4049819 | T | A |
| S_9452099 \| \| scaffold14851_4049821_SNP | 4049821 | A | C |
| S_9452306 \| \| scaffold14851_4052352_SNP | 4052352 | C | T |
| S_9452328 \| \| scaffold14851_4052742_SNP | 4052742 | T | G |
| S_9452336 \| \| scaffold14851_4052923_SNP | 4052923 | C | T |
| S_9452337 \| \| scaffold14851_4052932_SNP | 4052932 | A | G |
| S_9452348 \| \| scaffold14851_4053167_SNP | 4053167 | A | C |
| S_9452416 \| \| scaffold14851_4054238_SNP | 4054238 | A | T |
| S_9452538 \| \| scaffold14851_4056084_SNP | 4056084 | C | A |
| S_9452698 \| \| scaffold14851_4057757_SNP | 4057757 | T | A |
| S_9452717 \| \| scaffold14851_4057941_SNP | 4057941 | T | C |
| S_9452723 \| \| scaffold14851_4058143_SNP | 4058143 | C | A |
| S_9452725 \| \| scaffold14851_4058193_SNP | 4058193 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9452746 \| \| scaffold14851_4058327_SNP | 4058327 | A | T |
| S_9452808 \| \| scaffold14851_4059261_SNP | 4059261 | G | A |
| S_9452817 \| \| scaffold14851_4059364_SNP | 4059364 | G | C |
| S_9452821 \| \| scaffold14851_4059386_SNP | 4059386 | G | T |
| S_9452893 \| \| scaffold14851_4060650_SNP | 4060650 | A | G |
| S_9452922 \| \| scaffold14851_4061177_SNP | 4061177 | C | T |
| S_9452932 \| \| scaffold14851_4061459_SNP | 4061459 | A | G |
| S_9453065 \| \| scaffold14851_4063229_SNP | 4063229 | T | A |
| S_9453159 \| \| scaffold14851_4064278_SNP | 4064278 | C | A |
| scaffold14851_4064884_SNP | 4064884 | A | T |
| S_9453251 \| \| scaffold14851_4065209_SNP | 4065209 | C | G |
| S_9453303 \| \| scaffold14851_4066143_SNP | 4066143 | A | G |
| S_9453310 \| \| scaffold14851_4066298_SNP | 4066298 | A | G |
| scaffold14851_4066622_SNP | 4066622 | T | A |
| S_9453401 \| \| scaffold14851_4067955_SNP | 4067955 | G | T |
| S_9453517 \| \| scaffold14851_4069352_SNP | 4069352 | C | A |
| S_9453537 \| \| scaffold14851_4069621_SNP | 4069621 | A | C |
| S_9453628 \| \| scaffold14851_4071230_SNP | 4071230 | T | C |
| S_9453659 \| \| scaffold14851_4071721_SNP | 4071721 | G | C |
| S_9453661 \| \| scaffold14851_4071724_SNP | 4071724 | G | T |
| S_9453789 \| \| scaffold14851_4073281_SNP | 4073281 | C | T |
| S_9453803 \| \| scaffold14851_4073448_SNP | 4073448 | A | T |
| S_9453808 \| \| scaffold14851_4073482_SNP | 4073482 | C | T |
| S_9453829 \| \| scaffold14851_4073688_SNP | 4073688 | C | T |
| S_9453842 \| \| scaffold14851_4073849_SNP | 4073849 | G | A |
| S_9453849 \| \| scaffold14851_4073999_SNP | 4073999 | G | C |
| S_9453869 \| \| scaffold14851_4074418_SNP | 4074418 | G | A |
| S_9453872 \| \| scaffold14851_4074477_SNP | 4074477 | G | A |
| S_9453885 \| \| scaffold14851_4074827_SNP | 4074827 | T | C |
| S_9453932 \| \| scaffold14851_4075601_SNP | 4075601 | C | T |
| S_9453954 \| \| scaffold14851_4075943_SNP | 4075943 | T | A |
| S_9453966 \| \| scaffold14851_4076178_SNP | 4076178 | T | G |
| S_9453990 \| \| scaffold14851_4076641_SNP | 4076641 | T | C |
| S_9453997 \| \| scaffold14851_4076759_SNP | 4076759 | A | T |
| S_9454008 \| \| scaffold14851_4076861_SNP | 4076861 | C | T |
| S_9454088 \| \| scaffold14851_4077811_SNP | 4077811 | C | A |
| S_9454098 \| \| scaffold14851_4078036_SNP | 4078036 | C | T |
| S_9454174 \| \| scaffold14851_4078367_SNP | 4078367 | G | C |
| S_9454250 \| \| scaffold14851_4078512_SNP | 4078512 | G | A |
| S_9454257 \| \| scaffold14851_4078580_SNP | 4078580 | C | G |
| S_9454264 \| \| scaffold14851_4078849_SNP | 4078849 | G | C |
| S_9454301 \| \| scaffold14851_4079552_SNP | 4079552 | C | T |
| S_9454331 \| \| scaffold14851_4079968_SNP | 4079968 | G | A |
| S_9454351 \| \| scaffold14851_4080281_SNP | 4080281 | A | G |
| S_9454408 \| \| scaffold14851_4081032_SNP | 4081032 | C | A |
| S_9454426 \| \| scaffold14851_4081233_SNP | 4081233 | A | T |
| S_9454508 \| \| scaffold14851_4082113_SNP | 4082113 | C | G |
| S_9454516 \| \| scaffold14851_4082212_SNP | 4082212 | A | G |
| S_9455400 \| \| scaffold14851_4088408_SNP | 4088408 | A | G |
| S_9455500 \| \| scaffold14851_4089154_SNP | 4089154 | A | G |
| S_9455510 \| \| scaffold14851_4089240_SNP | 4089240 | T | A |
| S_9455522 \| \| scaffold14851_4089310_SNP | 4089310 | A | G |
| S_9455528 \| \| scaffold14851_4089449_SNP | 4089449 | T | A |
| S_9455533 \| \| scaffold14851_4089550_SNP | 4089550 | T | G |
| S_9455550 \| \| scaffold14851_4089875_SNP | 4089875 | G | T |
| S_9455606 \| \| scaffold14851_4090388_SNP | 4090388 | T | G |
| S_9455608 \| \| scaffold14851_4090412_SNP | 4090412 | C | T |
| S_9455615 \| \| scaffold14851_4090554_SNP | 4090554 | T | G |
| S_9455637 \| \| scaffold14851_4090934_SNP | 4090934 | T | C |
| S_9455640 \| \| scaffold14851_4090963_SNP | 4090963 | T | A |
| S_9455655 \| \| scaffold14851_4091196_SNP | 4091196 | T | A |
| S_9455659 \| \| scaffold14851_4091224_SNP | 4091224 | C | T |
| S_9455687 \| \| scaffold14851_4091438_SNP | 4091438 | T | C |
| S_9455688 \| \| scaffold14851_4091439_SNP | 4091439 | G | A |
| S_9455694 \| \| scaffold14851_4091533_SNP | 4091533 | C | T |
| S_9455760 \| \| scaffold14851_4092636_SNP | 4092636 | T | G |
| S_9455775 \| \| scaffold14851_4092919_SNP | 4092919 | T | A |
| S_9455780 \| \| scaffold14851_4093055_SNP | 4093055 | G | A |
| S_9455885 \| \| scaffold14851_4094749_SNP | 4094749 | A | T |
| S_9456184 \| \| scaffold14851_4099006_SNP | 4099006 | C | T |
| S_9456191 \| \| scaffold14851_4099174_SNP | 4099174 | A | T |
| S_9456194 \| \| scaffold14851_4099274_SNP | 4099274 | C | T |
| S_9456224 \| \| scaffold14851_4099952_SNP | 4099952 | C | G |
| S_9456253 \| \| scaffold14851_4100475_SNP | 4100475 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9456254 \| \| scaffold14851_4100482_SNP | 4100482 | A | C |
| S_9456258 \| \| scaffold14851_4100595_SNP | 4100595 | C | T |
| S_9456304 \| \| scaffold14851_4101344_SNP | 4101344 | A | T |
| S_9456340 \| \| scaffold14851_4101777_SNP | 4101777 | T | G |
| S_9456341 \| \| scaffold14851_4101806_SNP | 4101806 | G | A |
| S_9456397 \| \| scaffold14851_4102436_SNP | 4102436 | G | T |
| S_9456448 \| \| scaffold14851_4104112_SNP | 4104112 | A | G |
| S_9456462 \| \| scaffold14851_4104293_SNP | 4104293 | T | C |
| S_9456487 \| \| scaffold14851_4104673_SNP | 4104673 | A | C |
| S_9456569 \| \| scaffold14851_4105268_SNP | 4105268 | T | A |
| S_9456572 \| \| scaffold14851_4105332_SNP | 4105332 | A | C |
| S_9456574 \| \| scaffold14851_4105378_SNP | 4105378 | G | A |
| S_9456599 \| \| scaffold14851_4105739_SNP | 4105739 | C | T |
| S_9456608 \| \| scaffold14851_4105953_SNP | 4105953 | T | C |
| S_9456629 \| \| scaffold14851_4106094_SNP | 4106094 | C | T |
| S_9456638 \| \| scaffold14851_4106202_SNP | 4106202 | C | A |
| S_9456676 \| \| scaffold14851_4106853_SNP | 4106853 | A | G |
| S_9456679 \| \| scaffold14851_4106883_SNP | 4106883 | T | A |
| S_9456711 \| \| scaffold14851_4107462_SNP | 4107462 | G | C |
| S_9456721 \| \| scaffold14851_4107540_SNP | 4107540 | T | C |
| S_9456723 \| \| scaffold14851_4107553_SNP | 4107553 | C | T |
| S_9456726 \| \| scaffold14851_4107571_SNP | 4107571 | C | A |
| S_9456727 \| \| scaffold14851_4107579_SNP | 4107579 | G | A |
| S_9456730 \| \| scaffold14851_4107649_SNP | 4107649 | T | G |
| S_9456733 \| \| scaffold14851_4107664_SNP | 4107664 | G | A |
| S_9456781 \| \| scaffold14851_4108311_SNP | 4108311 | T | G |
| S_9456796 \| \| scaffold14851_4108727_SNP | 4108727 | T | A |
| S_9456810 \| \| scaffold14851_4108925_SNP | 4108925 | G | T |
| S_9456816 \| \| scaffold14851_4109044_SNP | 4109044 | A | G |
| S_9456845 \| \| scaffold14851_4109492_SNP | 4109492 | G | T |
| S_9456884 \| \| scaffold14851_4110077_SNP | 4110077 | C | A |
| S_9456885 \| \| scaffold14851_4110081_SNP | 4110081 | G | T |
| S_9457012 \| \| scaffold14851_4111877_SNP | 4111877 | C | G |
| S_9457080 \| \| scaffold14851_4112825_SNP | 4112825 | G | T |
| S_9457125 \| \| scaffold14851_4113833_SNP | 4113833 | A | G |
| S_9457135 \| \| scaffold14851_4114069_SNP | 4114069 | A | T |
| S_9457181 \| \| scaffold14851_4115004_SNP | 4115004 | A | C |
| S_9457204 \| \| scaffold14851_4115214_SNP | 4115214 | C | A |
| S_9457240 \| \| scaffold14851_4115499_SNP | 4115499 | A | G |
| S_9457245 \| \| scaffold14851_4115540_SNP | 4115540 | C | G |
| S_9457284 \| \| scaffold14851_4116200_SNP | 4116200 | G | T |
| S_9457376 \| \| scaffold14851_4117092_SNP | 4117092 | C | T |
| S_9457378 \| \| scaffold14851_4117096_SNP | 4117096 | C | T |
| S_9457379 \| \| scaffold14851_4117121_SNP | 4117121 | C | T |
| S_9457392 \| \| scaffold14851_4117262_SNP | 4117262 | A | G |
| S_9457483 \| \| scaffold14851_4118226_SNP | 4118226 | C | G |
| S_9457496 \| \| scaffold14851_4118361_SNP | 4118361 | A | G |
| S_9457499 \| \| scaffold14851_4118394_SNP | 4118394 | T | A |
| S_9457527 \| \| scaffold14851_4118864_SNP | 4118864 | G | A |
| S_9457615 \| \| scaffold14851_4119863_SNP | 4119863 | G | T |
| S_9457628 \| \| scaffold14851_4120147_SNP | 4120147 | A | G |
| S_9457643 \| \| scaffold14851_4120377_SNP | 4120377 | T | G |
| S_9457653 \| \| scaffold14851_4120507_SNP | 4120507 | T | G |
| S_9457657 \| \| scaffold14851_4120573_SNP | 4120573 | A | T |
| S_9457693 \| \| scaffold14851_4121133_SNP | 4121133 | T | G |
| S_9458036 \| \| scaffold14851_4125885_SNP | 4125885 | A | G |
| S_9458093 \| \| scaffold14851_4126358_SNP | 4126358 | C | T |
| S_9458135 \| \| scaffold14851_4127135_SNP | 4127135 | G | A |
| S_9458160 \| \| scaffold14851_4127501_SNP | 4127501 | A | C |
| S_9458179 \| \| scaffold14851_4127808_SNP | 4127808 | A | T |
| S_9458189 \| \| scaffold14851_4127878_SNP | 4127878 | G | A |
| S_9458339 \| \| scaffold14851_4129710_SNP | 4129710 | G | C |
| S_9458346 \| \| scaffold14851_4129878_SNP | 4129878 | T | G |
| S_9458357 \| \| scaffold14851_4130219_SNP | 4130219 | A | T |
| scaffold14851_4130452_SNP | 4130452 | G | T |
| S_9458505 \| \| scaffold14851_4131040_SNP | 4131040 | G | T |
| S_9458514 \| \| scaffold14851_4131229_SNP | 4131229 | G | A |
| S_9458640 \| \| scaffold14851_4132666_SNP | 4132666 | A | C |
| S_9458868 \| \| scaffold14851_4136188_SNP | 4136188 | C | T |
| S_9458918 \| \| scaffold14851_4136750_SNP | 4136750 | G | A |
| S_9458943 \| \| scaffold14851_4137044_SNP | 4137044 | A | G |
| S_9458958 \| \| scaffold14851_4137298_SNP | 4137298 | G | A |
| S_9458968 \| \| scaffold14851_4137423_SNP | 4137423 | T | C |
| S_9458977 \| \| scaffold14851_4137509_SNP | 4137509 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9459091 \| \| scaffold14851_4138463_SNP | 4138463 | C | T |
| S_9459092 \| \| scaffold14851_4138478_SNP | 4138478 | G | C |
| S_9459093 \| \| scaffold14851_4138490_SNP | 4138490 | C | T |
| S_9459094 \| \| scaffold14851_4138493_SNP | 4138493 | G | A |
| S_9459095 \| \| scaffold14851_4138496_SNP | 4138496 | G | A |
| S_9459109 \| \| scaffold14851_4138702_SNP | 4138702 | T | C |
| S_9459200 \| \| scaffold14851_4139656_SNP | 4139656 | T | G |
| S_9459214 \| \| scaffold14851_4139881_SNP | 4139881 | A | G |
| S_9459223 \| \| scaffold14851_4140031_SNP | 4140031 | A | T |
| S_9459225 \| \| scaffold14851_4140068_SNP | 4140068 | G | A |
| S_9459230 \| \| scaffold14851_4140182_SNP | 4140182 | A | G |
| S_9460031 \| \| scaffold14851_4153224_SNP | 4153224 | A | C |
| S_9460215 \| \| scaffold14851_4157651_SNP | 4157651 | G | A |
| S_9460216 \| \| scaffold14851_4157674_SNP | 4157674 | A | G |
| S_9460230 \| \| scaffold14851_4157886_SNP | 4157886 | G | C |
| S_9460290 \| \| scaffold14851_4158385_SNP | 4158385 | A | G |
| S_9460297 \| \| scaffold14851_4158472_SNP | 4158472 | C | T |
| S_9460303 \| \| scaffold14851_4158679_SNP | 4158679 | T | G |
| S_9460441 \| \| scaffold14851_4160426_SNP | 4160426 | A | G |
| S_9460491 \| \| scaffold14851_4161014_SNP | 4161014 | C | T |
| S_9460519 \| \| scaffold14851_4161377_SNP | 4161377 | T | A |
| S_9460548 \| \| scaffold14851_4161568_SNP | 4161568 | G | A |
| S_9460746 \| \| scaffold14851_4164153_SNP | 4164153 | T | C |
| S_9460754 \| \| scaffold14851_4164224_SNP | 4164224 | G | A |
| S_9460756 \| \| scaffold14851_4164232_SNP | 4164232 | T | C |
| scaffold14851_4164271_SNP | 4164271 | C | T |
| S_9460778 \| \| scaffold14851_4164309_SNP | 4164309 | G | A |
| scaffold14851_4164334_SNP | 4164334 | C | T |
| S_9460790 \| \| scaffold14851_4164357_SNP | 4164357 | T | C |
| S_9460792 \| \| scaffold14851_4164376_SNP | 4164376 | T | C |
| S_9460805 \| \| scaffold14851_4164477_SNP | 4164477 | T | G |
| S_9460832 \| \| scaffold14851_4164923_SNP | 4164923 | C | A |
| S_9460839 \| \| scaffold14851_4165012_SNP | 4165012 | A | G |
| S_9460854 \| \| scaffold14851_4165170_SNP | 4165170 | G | A |
| S_9460860 \| \| scaffold14851_4165257_SNP | 4165257 | C | T |
| S_9460867 \| \| scaffold14851_4165332_SNP | 4165332 | A | G |
| S_9460868 \| \| scaffold14851_4165339_SNP | 4165339 | G | A |
| S_9460870 \| \| scaffold14851_4165375_SNP | 4165375 | C | T |
| S_9460874 \| \| scaffold14851_4165395_SNP | 4165395 | A | G |
| S_9460887 \| \| scaffold14851_4165499_SNP | 4165499 | G | T |
| S_9460888 \| \| scaffold14851_4165502_SNP | 4165502 | T | C |
| S_9460890 \| \| scaffold14851_4165523_SNP | 4165523 | C | A |
| S_9460916 \| \| scaffold14851_4165810_SNP | 4165810 | G | A |
| S_9460946 \| \| scaffold14851_4166081_SNP | 4166081 | G | A |
| S_9461012 \| \| scaffold14851_4166367_SNP | 4166367 | C | T |
| S_9461027 \| \| scaffold14851_4166556_SNP | 4166556 | T | A |
| S_9461050 \| \| scaffold14851_4166969_SNP | 4166969 | C | T |
| S_9461059 \| \| scaffold14851_4167047_SNP | 4167047 | T | C |
| S_9461064 \| \| scaffold14851_4167160_SNP | 4167160 | A | T |
| S_9461068 \| \| scaffold14851_4167206_SNP | 4167206 | T | G |
| S_9461070 \| \| scaffold14851_4167259_SNP | 4167259 | T | C |
| S_9461155 \| \| scaffold14851_4168455_SNP | 4168455 | C | A |
| S_9461156 \| \| scaffold14851_4168470_SNP | 4168470 | A | T |
| S_9461163 \| \| scaffold14851_4168616_SNP | 4168616 | A | T |
| S_9461165 \| \| scaffold14851_4168660_SNP | 4168660 | T | A |
| S_9461183 \| \| scaffold14851_4169040_SNP | 4169040 | A | T |
| S_9461330 \| \| scaffold14851_4169886_SNP | 4169886 | T | G |
| S_9461333 \| \| scaffold14851_4169906_SNP | 4169906 | C | G |
| S_9461363 \| \| scaffold14851_4170494_SNP | 4170494 | G | A |
| S_9461364 \| \| scaffold14851_4170510_SNP | 4170510 | G | A |
| S_9461371 \| \| scaffold14851_4170612_SNP | 4170612 | A | G |
| S_9461391 \| \| scaffold14851_4170949_SNP | 4170949 | C | A |
| S_9461410 \| \| scaffold14851_4171234_SNP | 4171234 | A | C |
| S_9461435 \| \| scaffold14851_4171658_SNP | 4171658 | T | G |
| S_9461457 \| \| scaffold14851_4172109_SNP | 4172109 | C | T |
| S_9461461 \| \| scaffold14851_4172221_SNP | 4172221 | T | C |
| S_9461464 \| \| scaffold14851_4172247_SNP | 4172247 | G | A |
| S_9461466 \| \| scaffold14851_4172325_SNP | 4172325 | T | C |
| S_9461489 \| \| scaffold14851_4172775_SNP | 4172775 | T | G |
| S_9461492 \| \| scaffold14851_4172819_SNP | 4172819 | A | G |
| S_9461496 \| \| scaffold14851_4172880_SNP | 4172880 | T | A |
| S_9461502 \| \| scaffold14851_4172943_SNP | 4172943 | A | G |
| S_9461506 \| \| scaffold14851_4172994_SNP | 4172994 | A | G |
| S_9461515 \| \| scaffold14851_4173088_SNP | 4173088 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9461519 \| \| scaffold14851_4173143_SNP | 4173143 | T | C |
| S_9461520 \| \| scaffold14851_4173144_SNP | 4173144 | G | C |
| S_9461591 \| \| scaffold14851_4173664_SNP | 4173664 | T | C |
| S_9461598 \| \| scaffold14851_4173769_SNP | 4173769 | A | C |
| S_9461601 \| \| scaffold14851_4173814_SNP | 4173814 | C | T |
| S_9461625 \| \| scaffold14851_4174070_SNP | 4174070 | G | C |
| S_9461773 \| \| scaffold14851_4176123_SNP | 4176123 | G | A |
| S_9461774 \| \| scaffold14851_4176137_SNP | 4176137 | T | A |
| S_9461775 \| \| scaffold14851_4176166_SNP | 4176166 | A | T |
| S_9461778 \| \| scaffold14851_4176222_SNP | 4176222 | T | G |
| S_9461801 \| \| scaffold14851_4176423_SNP | 4176423 | G | C |
| S_9461841 \| \| scaffold14851_4176684_SNP | 4176684 | G | A |
| S_9461844 \| \| scaffold14851_4176731_SNP | 4176731 | A | G |
| S_9461852 \| \| scaffold14851_4176781_SNP | 4176781 | C | G |
| S_9461853 \| \| scaffold14851_4176788_SNP | 4176788 | T | A |
| S_9461872 \| \| scaffold14851_4176831_SNP | 4176831 | T | A |
| S_9461875 \| \| scaffold14851_4176832_SNP | 4176832 | T | C |
| S_9461894 \| \| scaffold14851_4177023_SNP | 4177023 | T | G |
| S_9461905 \| \| scaffold14851_4177140_SNP | 4177140 | G | T |
| S_9461919 \| \| scaffold14851_4177257_SNP | 4177257 | A | T |
| S_9461991 \| \| scaffold14851_4178175_SNP | 4178175 | G | A |
| S_9462038 \| \| scaffold14851_4178751_SNP | 4178751 | G | A |
| S_9462039 \| \| scaffold14851_4178798_SNP | 4178798 | G | A |
| S_9462060 \| \| scaffold14851_4179067_SNP | 4179067 | A | G |
| S_9462063 \| \| scaffold14851_4179237_SNP | 4179237 | T | C |
| S_9462075 \| \| scaffold14851_4179456_SNP | 4179456 | C | T |
| S_9462077 \| \| scaffold14851_4179481_SNP | 4179481 | C | T |
| S_9462094 \| \| scaffold14851_4179750_SNP | 4179750 | G | A |
| S_9462095 \| \| scaffold14851_4179760_SNP | 4179760 | T | A |
| S_9462101 \| \| scaffold14851_4179850_SNP | 4179850 | G | C |
| S_9462106 \| \| scaffold14851_4179923_SNP | 4179923 | G | C |
| S_9462116 \| \| scaffold14851_4180098_SNP | 4180098 | T | C |
| S_9462117 \| \| scaffold14851_4180100_SNP | 4180100 | C | A |
| S_9462126 \| \| scaffold14851_4180178_SNP | 4180178 | G | C |
| S_9462131 \| \| scaffold14851_4180254_SNP | 4180254 | T | A |
| S_9462134 \| \| scaffold14851_4180305_SNP | 4180305 | G | C |
| S_9462154 \| \| scaffold14851_4180534_SNP | 4180534 | C | T |
| S_9462232 \| \| scaffold14851_4181468_SNP | 4181468 | G | C |
| S_9462247 \| \| scaffold14851_4181602_SNP | 4181602 | A | T |
| S_9462295 \| \| scaffold14851_4182296_SNP | 4182296 | A | T |
| S_9462296 \| \| scaffold14851_4182297_SNP | 4182297 | A | T |
| S_9462299 \| \| scaffold14851_4182424_SNP | 4182424 | A | C |
| S_9462318 \| \| scaffold14851_4182626_SNP | 4182626 | G | A |
| S_9462319 \| \| scaffold14851_4182640_SNP | 4182640 | T | A |
| S_9462321 \| \| scaffold14851_4182665_SNP | 4182665 | G | A |
| S_9462364 \| \| scaffold14851_4183196_SNP | 4183196 | A | T |
| S_9462367 \| \| scaffold14851_4183238_SNP | 4183238 | C | A |
| S_9462368 \| \| scaffold14851_4183267_SNP | 4183267 | T | C |
| S_9462380 \| \| scaffold14851_4183390_SNP | 4183390 | C | A |
| S_9462388 \| \| scaffold14851_4183523_SNP | 4183523 | A | G |
| S_9462411 \| \| scaffold14851_4183773_SNP | 4183773 | T | A |
| S_9462430 \| \| scaffold14851_4184035_SNP | 4184035 | A | G |
| S_9462431 \| \| scaffold14851_4184040_SNP | 4184040 | G | C |
| S_9462433 \| \| scaffold14851_4184093_SNP | 4184093 | A | G |
| S_9462435 \| \| scaffold14851_4184112_SNP | 4184112 | T | G |
| S_9462489 \| \| scaffold14851_4184846_SNP | 4184846 | T | C |
| S_9462496 \| \| scaffold14851_4184927_SNP | 4184927 | C | A |
| S_9462509 \| \| scaffold14851_4185004_SNP | 4185004 | C | T |
| S_9462546 \| \| scaffold14851_4185581_SNP | 4185581 | A | T |
| S_9462548 \| \| scaffold14851_4185641_SNP | 4185641 | T | C |
| S_9462553 \| \| scaffold14851_4185694_SNP | 4185694 | T | G |
| S_9462555 \| \| scaffold14851_4185703_SNP | 4185703 | T | A |
| S_9462564 \| \| scaffold14851_4185778_SNP | 4185778 | T | C |
| S_9462571 \| \| scaffold14851_4186030_SNP | 4186030 | A | G |
| S_9462572 \| \| scaffold14851_4186035_SNP | 4186035 | A | G |
| S_9462585 \| \| scaffold14851_4186183_SNP | 4186183 | C | T |
| S_9462586 \| \| scaffold14851_4186186_SNP | 4186186 | G | A |
| S_9462592 \| \| scaffold14851_4186258_SNP | 4186258 | T | C |
| S_9462599 \| \| scaffold14851_4186362_SNP | 4186362 | G | T |
| S_9462652 \| \| scaffold14851_4187173_SNP | 4187173 | T | C |
| S_9462682 \| \| scaffold14851_4187237_SNP | 4187237 | A | T |
| S_9462689 \| \| scaffold14851_4187246_SNP | 4187246 | C | T |
| S_9462694 \| \| scaffold14851_4187250_SNP | 4187250 | C | T |
| S_9462717 \| \| scaffold14851_4187318_SNP | 4187318 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9462739 \| \| scaffold14851_4187616_SNP | 4187616 | G | A |
| S_9462743 \| \| scaffold14851_4187722_SNP | 4187722 | A | T |
| S_9462755 \| \| scaffold14851_4187997_SNP | 4187997 | T | C |
| S_9462762 \| \| scaffold14851_4188078_SNP | 4188078 | A | G |
| S_9462770 \| \| scaffold14851_4188164_SNP | 4188164 | G | A |
| S_9462771 \| \| scaffold14851_4188167_SNP | 4188167 | T | A |
| S_9462773 \| \| scaffold14851_4188175_SNP | 4188175 | A | T |
| S_9462777 \| \| scaffold14851_4188232_SNP | 4188232 | T | G |
| S_9462779 \| \| scaffold14851_4188254_SNP | 4188254 | A | G |
| S_9462784 \| \| scaffold14851_4188291_SNP | 4188291 | A | G |
| S_9462852 \| \| scaffold14851_4189361_SNP | 4189361 | T | A |
| S_9462853 \| \| scaffold14851_4189376_SNP | 4189376 | G | C |
| S_9462868 \| \| scaffold14851_4189668_SNP | 4189668 | G | A |
| S_9462877 \| \| scaffold14851_4189797_SNP | 4189797 | T | C |
| S_9462878 \| \| scaffold14851_4189799_SNP | 4189799 | C | T |
| S_9462882 \| \| scaffold14851_4189885_SNP | 4189885 | C | T |
| S_9462893 \| \| scaffold14851_4189996_SNP | 4189996 | T | G |
| S_9462895 \| \| scaffold14851_4190029_SNP | 4190029 | A | G |
| S_9462905 \| \| scaffold14851_4190171_SNP | 4190171 | A | G |
| S_9462908 \| \| scaffold14851_4190190_SNP | 4190190 | A | G |
| S_9462909 \| \| scaffold14851_4190198_SNP | 4190198 | C | T |
| S_9462911 \| \| scaffold14851_4190266_SNP | 4190266 | G | A |
| S_9463000 \| \| scaffold14851_4191304_SNP | 4191304 | A | T |
| S_9463016 \| \| scaffold14851_4191469_SNP | 4191469 | C | T |
| scaffold14851_4191562_SNP | 4191562 | C | T |
| S_9463032 \| \| scaffold14851_4191569_SNP | 4191569 | T | A |
| S_9463057 \| \| scaffold14851_4191696_SNP | 4191696 | G | A |
| S_9463066 \| \| scaffold14851_4191781_SNP | 4191781 | A | T |
| S_9463146 \| \| scaffold14851_4192303_SNP | 4192303 | C | A |
| S_9463157 \| \| scaffold14851_4192399_SNP | 4192399 | G | C |
| S_9463168 \| \| scaffold14851_4192480_SNP | 4192480 | A | T |
| S_9463180 \| \| scaffold14851_4192634_SNP | 4192634 | A | G |
| S_9463187 \| \| scaffold14851_4192698_SNP | 4192698 | C | T |
| S_9463192 \| \| scaffold14851_4192754_SNP | 4192754 | A | T |
| S_9463197 \| \| scaffold14851_4192862_SNP | 4192862 | G | A |
| S_9463199 \| \| scaffold14851_4192871_SNP | 4192871 | A | T |
| S_9463298 \| \| scaffold14851_4194073_SNP | 4194073 | G | A |
| S_9463307 \| \| scaffold14851_4194196_SNP | 4194196 | G | A |
| S_9463308 \| \| scaffold14851_4194202_SNP | 4194202 | T | A |
| S_9463310 \| \| scaffold14851_4194237_SNP | 4194237 | G | A |
| S_9463320 \| \| scaffold14851_4194443_SNP | 4194443 | A | T |
| S_9463321 \| \| scaffold14851_4194444_SNP | 4194444 | A | G |
| S_9463327 \| \| scaffold14851_4194520_SNP | 4194520 | A | G |
| S_9463352 \| \| scaffold14851_4194746_SNP | 4194746 | T | C |
| S_9463493 \| \| scaffold14851_4196274_SNP | 4196274 | G | A |
| S_9463645 \| \| scaffold14851_4198479_SNP | 4198479 | A | T |
| S_9463670 \| \| scaffold14851_4199134_SNP | 4199134 | C | T |
| S_9463671 \| \| scaffold14851_4199141_SNP | 4199141 | T | C |
| S_9463722 \| \| scaffold14851_4199619_SNP | 4199619 | T | G |
| S_9463903 \| \| scaffold14851_4201020_SNP | 4201020 | T | A |
| S_9463932 \| \| scaffold14851_4201426_SNP | 4201426 | A | C |
| S_9463933 \| \| scaffold14851_4201435_SNP | 4201435 | T | C |
| S_9464032 \| \| scaffold14851_4202871_SNP | 4202871 | A | G |
| S_9464118 \| \| scaffold14851_4204017_SNP | 4204017 | C | T |
| S_9464135 \| \| scaffold14851_4204403_SNP | 4204403 | C | T |
| S_9464138 \| \| scaffold14851_4204459_SNP | 4204459 | A | C |
| S_9464140 \| \| scaffold14851_4204486_SNP | 4204486 | C | T |
| S_9464143 \| \| scaffold14851_4204512_SNP | 4204512 | C | T |
| S_9464154 \| \| scaffold14851_4204730_SNP | 4204730 | A | G |
| S_9464275 \| \| scaffold14851_4206374_SNP | 4206374 | G | T |
| S_9464350 \| \| scaffold14851_4207363_SNP | 4207363 | A | T |
| S_9464356 \| \| scaffold14851_4207523_SNP | 4207523 | A | G |
| S_9464396 \| \| scaffold14851_4208094_SNP | 4208094 | G | A |
| S_9464486 \| \| scaffold14851_4208353_SNP | 4208353 | G | T |
| S_9464495 \| \| scaffold14851_4208427_SNP | 4208427 | A | C |
| S_9464532 \| \| scaffold14851_4209171_SNP | 4209171 | G | C |
| S_9464623 \| \| scaffold14851_4210272_SNP | 4210272 | A | G |
| S_9464628 \| \| scaffold14851_4210341_SNP | 4210341 | G | T |
| S_9464661 \| \| scaffold14851_4210714_SNP | 4210714 | A | T |
| S_9464665 \| \| scaffold14851_4210819_SNP | 4210819 | A | G |
| S_9464677 \| \| scaffold14851_4210945_SNP | 4210945 | C | A |
| S_9464771 \| \| scaffold14851_4212542_SNP | 4212542 | C | T |
| S_9464780 \| \| scaffold14851_4212742_SNP | 4212742 | A | G |
| S_9464782 \| \| scaffold14851_4212777_SNP | 4212777 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9464787 \| \| scaffold14851_4212879_SNP | 4212879 | T | A |
| S_9464792 \| \| scaffold14851_4212953_SNP | 4212953 | G | T |
| S_9464876 \| \| scaffold14851_4214442_SNP | 4214442 | A | T |
| S_9464879 \| \| scaffold14851_4214520_SNP | 4214520 | A | G |
| S_9464887 \| \| scaffold14851_4214694_SNP | 4214694 | C | A |
| S_9464890 \| \| scaffold14851_4214744_SNP | 4214744 | T | C |
| S_9464891 \| \| scaffold14851_4214753_SNP | 4214753 | G | A |
| S_9464987 \| \| scaffold14851_4216281_SNP | 4216281 | C | G |
| S_9464997 \| \| scaffold14851_4216389_SNP | 4216389 | A | G |
| S_9465001 \| \| scaffold14851_4216429_SNP | 4216429 | G | A |
| S_9465015 \| \| scaffold14851_4216550_SNP | 4216550 | T | G |
| S_9465042 \| \| scaffold14851_4216848_SNP | 4216848 | A | T |
| S_9465044 \| \| scaffold14851_4216860_SNP | 4216860 | G | T |
| S_9465047 \| \| scaffold14851_4216936_SNP | 4216936 | G | A |
| S_9465060 \| \| scaffold14851_4217124_SNP | 4217124 | C | G |
| S_9465069 \| \| scaffold14851_4217285_SNP | 4217285 | C | T |
| S_9465078 \| \| scaffold14851_4217433_SNP | 4217433 | A | C |
| S_9465175 \| \| scaffold14851_4219066_SNP | 4219066 | G | A |
| S_9465180 \| \| scaffold14851_4219196_SNP | 4219196 | C | T |
| S_9465226 \| \| scaffold14851_4219662_SNP | 4219662 | A | C |
| S_9465245 \| \| scaffold14851_4220317_SNP | 4220317 | T | C |
| S_9465262 \| \| scaffold14851_4220569_SNP | 4220569 | G | A |
| S_9465389 \| \| scaffold14851_4221793_SNP | 4221793 | G | A |
| S_9465398 \| \| scaffold14851_4221869_SNP | 4221869 | G | T |
| S_9465425 \| \| scaffold14851_4222087_SNP | 4222087 | C | A |
| S_9465430 \| \| scaffold14851_4222170_SNP | 4222170 | A | T |
| S_9465434 \| \| scaffold14851_4222354_SNP | 4222354 | G | C |
| S_9465435 \| \| scaffold14851_4222370_SNP | 4222370 | A | T |
| scaffold14851_4222707_SNP | 4222707 | T | C |
| S_9465491 \| \| scaffold14851_4222809_SNP | 4222809 | T | C |
| S_9465497 \| \| scaffold14851_4222888_SNP | 4222888 | C | T |
| S_9465499 \| \| scaffold14851_4222906_SNP | 4222906 | A | G |
| S_9465504 \| \| scaffold14851_4222992_SNP | 4222992 | G | A |
| S_9465509 \| \| scaffold14851_4223049_SNP | 4223049 | C | A |
| S_9465567 \| \| scaffold14851_4223716_SNP | 4223716 | C | T |
| S_9465677 \| \| scaffold14851_4224818_SNP | 4224818 | A | C |
| S_9465682 \| \| scaffold14851_4224874_SNP | 4224874 | C | T |
| S_9465686 \| \| scaffold14851_4224960_SNP | 4224960 | C | T |
| S_9465695 \| \| scaffold14851_4225226_SNP | 4225226 | T | G |
| S_9465699 \| \| scaffold14851_4225457_SNP | 4225457 | T | C |
| S_9465759 \| \| scaffold14851_4226498_SNP | 4226498 | G | T |
| S_9465911 \| \| scaffold14851_4229078_SNP | 4229078 | G | A |
| S_9465954 \| \| scaffold14851_4229558_SNP | 4229558 | C | T |
| S_9465973 \| \| scaffold14851_4229853_SNP | 4229853 | T | C |
| S_9465977 \| \| scaffold14851_4229871_SNP | 4229871 | A | G |
| S_9465978 \| \| scaffold14851_4229876_SNP | 4229876 | T | C |
| S_9466036 \| \| scaffold14851_4230424_SNP | 4230424 | T | C |
| S_9466067 \| \| scaffold14851_4230827_SNP | 4230827 | G | A |
| S_9466074 \| \| scaffold14851_4230988_SNP | 4230988 | G | C |
| S_9466134 \| \| scaffold14851_4231607_SNP | 4231607 | T | G |
| S_9466186 \| \| scaffold14851_4232294_SNP | 4232294 | G | A |
| S_9466210 \| \| scaffold14851_4232540_SNP | 4232540 | C | A |
| S_9466299 \| \| scaffold14851_4233848_SNP | 4233848 | A | G |
| S_9466302 \| \| scaffold14851_4233859_SNP | 4233859 | T | C |
| S_9466351 \| \| scaffold14851_4234555_SNP | 4234555 | A | T |
| S_9466526 \| \| scaffold14851_4236760_SNP | 4236760 | A | G |
| S_9466537 \| \| scaffold14851_4236883_SNP | 4236883 | A | G |
| S_9467543 \| \| scaffold14851_4239271_SNP | 4239271 | C | T |
| scaffold14851_4241011_SNP | 4241011 | C | T |
| scaffold14851_4241479_SNP | 4241479 | T | C |
| S_9468194 \| \| scaffold14851_4241481_SNP | 4241481 | T | C |
| S_9468195 \| \| scaffold14851_4241482_SNP | 4241482 | A | G |
| scaffold14851_4241540_SNP | 4241540 | A | G |
| S_9470339 \| \| scaffold14851_4247827_SNP | 4247827 | A | G |
| S_9471342 \| \| scaffold14851_4252540_SNP | 4252540 | A | C |
| S_9471352 \| \| scaffold14851_4252607_SNP | 4252607 | G | A |
| S_9471353 \| \| scaffold14851_4252642_SNP | 4252642 | A | C |
| S_9471366 \| \| scaffold14851_4252787_SNP | 4252787 | A | G |
| S_9471415 \| \| scaffold14851_4253024_SNP | 4253024 | C | T |
| S_9471482 \| \| scaffold14851_4253185_SNP | 4253185 | C | T |
| S_9471484 \| \| scaffold14851_4253191_SNP | 4253191 | T | C |
| S_9471499 \| \| scaffold14851_4253261_SNP | 4253261 | C | T |
| S_9471502 \| \| scaffold14851_4253280_SNP | 4253280 | T | C |
| S_9471515 \| \| scaffold14851_4253336_SNP | 4253336 | C | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9471586 \| \| scaffold14851_4254438_SNP | 4254438 | T | A |
| S_9471589 \| \| scaffold14851_4254560_SNP | 4254560 | T | A |
| S_9471590 \| \| scaffold14851_4254574_SNP | 4254574 | T | C |
| S_9471630 \| \| scaffold14851_4255179_SNP | 4255179 | A | G |
| S_9471640 \| \| scaffold14851_4255233_SNP | 4255233 | G | A |
| S_9471657 \| \| scaffold14851_4255427_SNP | 4255427 | G | A |
| S_9471670 \| \| scaffold14851_4255626_SNP | 4255626 | A | T |
| S_9471761 \| \| scaffold14851_4256804_SNP | 4256804 | T | C |
| S_9471999 \| \| scaffold14851_4259159_SNP | 4259159 | G | A |
| S_9472000 \| \| scaffold14851_4259168_SNP | 4259168 | C | A |
| S_9472006 \| \| scaffold14851_4259233_SNP | 4259233 | C | A |
| S_9472007 \| \| scaffold14851_4259267_SNP | 4259267 | A | G |
| S_9472011 \| \| scaffold14851_4259300_SNP | 4259300 | G | T |
| S_9472018 \| \| scaffold14851_4259402_SNP | 4259402 | G | A |
| S_9472020 \| \| scaffold14851_4259419_SNP | 4259419 | T | C |
| S_9472035 \| \| scaffold14851_4259532_SNP | 4259532 | C | G |
| S_9472052 \| \| scaffold14851_4259631_SNP | 4259631 | G | A |
| S_9472057 \| \| scaffold14851_4259664_SNP | 4259664 | T | C |
| S_9472058 \| \| scaffold14851_4259693_SNP | 4259693 | A | C |
| S_9472091 \| \| scaffold14851_4259907_SNP | 4259907 | A | G |
| S_9472099 \| \| scaffold14851_4259943_SNP | 4259943 | T | G |
| S_9472187 \| \| scaffold14851_4260644_SNP | 4260644 | G | T |
| S_9472194 \| \| scaffold14851_4260792_SNP | 4260792 | T | A |
| S_9472214 \| \| scaffold14851_4261032_SNP | 4261032 | T | C |
| S_9472234 \| \| scaffold14851_4261452_SNP | 4261452 | A | C |
| S_9472235 \| \| scaffold14851_4261465_SNP | 4261465 | A | G |
| S_9472289 \| \| scaffold14851_4262228_SNP | 4262228 | C | T |
| S_9472308 \| \| scaffold14851_4262495_SNP | 4262495 | G | A |
| S_9472314 \| \| scaffold14851_4262570_SNP | 4262570 | T | A |
| S_9472336 \| \| scaffold14851_4262927_SNP | 4262927 | A | T |
| S_9472398 \| \| scaffold14851_4263231_SNP | 4263231 | C | A |
| S_9472430 \| \| scaffold14851_4263982_SNP | 4263982 | T | C |
| S_9472432 \| \| scaffold14851_4264066_SNP | 4264066 | G | T |
| S_9472474 \| \| scaffold14851_4264667_SNP | 4264667 | A | C |
| S_9472491 \| \| scaffold14851_4264912_SNP | 4264912 | C | T |
| S_9472502 \| \| scaffold14851_4265075_SNP | 4265075 | C | T |
| S_9472504 \| \| scaffold14851_4265090_SNP | 4265090 | T | A |
| S_9472517 \| \| scaffold14851_4265269_SNP | 4265269 | T | C |
| S_9472518 \| \| scaffold14851_4265275_SNP | 4265275 | A | T |
| S_9472519 \| \| scaffold14851_4265281_SNP | 4265281 | A | T |
| S_9472630 \| \| scaffold14851_4266816_SNP | 4266816 | C | T |
| S_9472632 \| \| scaffold14851_4266881_SNP | 4266881 | C | A |
| S_9472634 \| \| scaffold14851_4266931_SNP | 4266931 | A | T |
| S_9472646 \| \| scaffold14851_4267151_SNP | 4267151 | G | T |
| S_9472889 \| \| scaffold14851_4270419_SNP | 4270419 | C | T |
| S_9472933 \| \| scaffold14851_4271429_SNP | 4271429 | C | T |
| S_9472934 \| \| scaffold14851_4271441_SNP | 4271441 | G | A |
| S_9472938 \| \| scaffold14851_4271502_SNP | 4271502 | A | C |
| S_9472972 \| \| scaffold14851_4271852_SNP | 4271852 | T | C |
| S_9472974 \| \| scaffold14851_4271889_SNP | 4271889 | A | T |
| S_9473011 \| \| scaffold14851_4272611_SNP | 4272611 | A | T |
| S_9473023 \| \| scaffold14851_4272806_SNP | 4272806 | C | T |
| S_9473039 \| \| scaffold14851_4273047_SNP | 4273047 | C | T |
| S_9473046 \| \| scaffold14851_4273129_SNP | 4273129 | C | T |
| S_9473049 \| \| scaffold14851_4273136_SNP | 4273136 | A | C |
| S_9473064 \| \| scaffold14851_4273336_SNP | 4273336 | A | G |
| S_9473066 \| \| scaffold14851_4273365_SNP | 4273365 | G | A |
| S_9473075 \| \| scaffold14851_4273455_SNP | 4273455 | T | C |
| S_9473078 \| \| scaffold14851_4273509_SNP | 4273509 | G | A |
| S_9473206 \| \| scaffold14851_4274464_SNP | 4274464 | G | A |
| S_9473243 \| \| scaffold14851_4274924_SNP | 4274924 | A | T |
| S_9473353 \| \| scaffold14851_4276142_SNP | 4276142 | C | G |
| S_9473369 \| \| scaffold14851_4276379_SNP | 4276379 | A | G |
| S_9473380 \| \| scaffold14851_4276549_SNP | 4276549 | T | G |
| S_9473397 \| \| scaffold14851_4276696_SNP | 4276696 | G | C |
| S_9473457 \| \| scaffold14851_4277383_SNP | 4277383 | A | G |
| S_9473474 \| \| scaffold14851_4277694_SNP | 4277694 | A | G |
| S_9473589 \| \| scaffold14851_4279137_SNP | 4279137 | A | G |
| S_9473592 \| \| scaffold14851_4279232_SNP | 4279232 | C | T |
| S_9473627 \| \| scaffold14851_4279692_SNP | 4279692 | A | G |
| S_9473629 \| \| scaffold14851_4279711_SNP | 4279711 | T | C |
| S_9473649 \| \| scaffold14851_4280102_SNP | 4280102 | T | A |
| S_9473660 \| \| scaffold14851_4280214_SNP | 4280214 | T | A |
| S_9473662 \| \| scaffold14851_4280235_SNP | 4280235 | A | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9473666 \|\| scaffold14851_4280328_SNP | 4280328 | G | A |
| S_9473669 \|\| scaffold14851_4280365_SNP | 4280365 | T | A |
| S_9473671 \|\| scaffold14851_4280394_SNP | 4280394 | G | C |
| S_9473697 \|\| scaffold14851_4280634_SNP | 4280634 | T | C |
| S_9473698 \|\| scaffold14851_4280635_SNP | 4280635 | A | G |
| S_9473700 \|\| scaffold14851_4280665_SNP | 4280665 | G | A |
| S_9473705 \|\| scaffold14851_4280771_SNP | 4280771 | C | T |
| S_9473707 \|\| scaffold14851_4280802_SNP | 4280802 | C | T |
| S_9473708 \|\| scaffold14851_4280821_SNP | 4280821 | A | G |
| S_9473774 \|\| scaffold14851_4281295_SNP | 4281295 | T | C |
| S_9473779 \|\| scaffold14851_4281392_SNP | 4281392 | T | C |
| S_9473782 \|\| scaffold14851_4281413_SNP | 4281413 | G | A |
| S_9473784 \|\| scaffold14851_4281468_SNP | 4281468 | A | G |
| S_9473785 \|\| scaffold14851_4281495_SNP | 4281495 | A | G |
| S_9473799 \|\| scaffold14851_4281859_SNP | 4281859 | A | C |
| S_9473800 \|\| scaffold14851_4281874_SNP | 4281874 | T | G |
| S_9473972 \|\| scaffold14851_4284577_SNP | 4284577 | G | A |
| S_9473981 \|\| scaffold14851_4284737_SNP | 4284737 | G | A |
| S_9474053 \|\| scaffold14851_4284950_SNP | 4284950 | A | G |
| S_9474073 \|\| scaffold14851_4285007_SNP | 4285007 | C | T |
| S_9474100 \|\| scaffold14851_4285401_SNP | 4285401 | T | C |
| S_9474172 \|\| scaffold14851_4286340_SNP | 4286340 | T | C |
| S_9474181 \|\| scaffold14851_4286465_SNP | 4286465 | A | G |
| S_9474184 \|\| scaffold14851_4286474_SNP | 4286474 | A | C |
| S_9474187 \|\| scaffold14851_4286489_SNP | 4286489 | C | G |
| S_9474188 \|\| scaffold14851_4286544_SNP | 4286544 | A | T |
| S_9474245 \|\| scaffold14851_4287034_SNP | 4287034 | A | C |
| S_9474249 \|\| scaffold14851_4287086_SNP | 4287086 | A | G |
| S_9474281 \|\| scaffold14851_4287532_SNP | 4287532 | A | G |
| S_9474288 \|\| scaffold14851_4287599_SNP | 4287599 | A | C |
| S_9474296 \|\| scaffold14851_4287682_SNP | 4287682 | G | T |
| S_9474326 \|\| scaffold14851_4288135_SNP | 4288135 | T | G |
| S_9474344 \|\| scaffold14851_4288224_SNP | 4288224 | T | C |
| S_9474375 \|\| scaffold14851_4288772_SNP | 4288772 | A | G |
| S_9474376 \|\| scaffold14851_4288788_SNP | 4288788 | A | G |
| scaffold14851_4288958_SNP | 4288958 | T | A |
| S_9474393 \|\| scaffold14851_4288966_SNP | 4288966 | G | T |
| S_9474394 \|\| scaffold14851_4288967_SNP | 4288967 | G | T |
| S_9474415 \|\| scaffold14851_4289278_SNP | 4289278 | C | A |
| S_9474427 \|\| scaffold14851_4289458_SNP | 4289458 | C | T |
| S_9474430 \|\| scaffold14851_4289585_SNP | 4289585 | T | G |
| S_9474489 \|\| scaffold14851_4290307_SNP | 4290307 | A | T |
| S_9474494 \|\| scaffold14851_4290357_SNP | 4290357 | G | T |
| S_9474495 \|\| scaffold14851_4290358_SNP | 4290358 | G | T |
| S_9474500 \|\| scaffold14851_4290495_SNP | 4290495 | T | A |
| S_9474512 \|\| scaffold14851_4290610_SNP | 4290610 | G | T |
| S_9474531 \|\| scaffold14851_4290893_SNP | 4290893 | C | T |
| S_9474532 \|\| scaffold14851_4290896_SNP | 4290896 | A | G |
| S_9474533 \|\| scaffold14851_4290948_SNP | 4290948 | C | T |
| S_9474545 \|\| scaffold14851_4291117_SNP | 4291117 | A | C |
| S_9474554 \|\| scaffold14851_4291276_SNP | 4291276 | T | C |
| S_9474555 \|\| scaffold14851_4291277_SNP | 4291277 | A | C |
| S_9474567 \|\| scaffold14851_4291520_SNP | 4291520 | A | G |
| S_9474581 \|\| scaffold14851_4291715_SNP | 4291715 | G | A |
| S_9474582 \|\| scaffold14851_4291733_SNP | 4291733 | C | T |
| S_9474584 \|\| scaffold14851_4291809_SNP | 4291809 | A | T |
| S_9474590 \|\| scaffold14851_4291886_SNP | 4291886 | C | A |
| S_9474612 \|\| scaffold14851_4292179_SNP | 4292179 | C | A |
| S_9474629 \|\| scaffold14851_4292316_SNP | 4292316 | T | C |
| S_9474631 \|\| scaffold14851_4292333_SNP | 4292333 | C | T |
| S_9474761 \|\| scaffold14851_4293390_SNP | 4293390 | T | A |
| S_9474780 \|\| scaffold14851_4293635_SNP | 4293635 | A | G |
| S_9474789 \|\| scaffold14851_4293733_SNP | 4293733 | A | T |
| S_9474797 \|\| scaffold14851_4293865_SNP | 4293865 | G | T |
| S_9474799 \|\| scaffold14851_4293926_SNP | 4293926 | C | T |
| S_9474806 \|\| scaffold14851_4294008_SNP | 4294008 | A | G |
| S_9474810 \|\| scaffold14851_4294098_SNP | 4294098 | G | T |
| S_9474815 \|\| scaffold14851_4294163_SNP | 4294163 | C | G |
| S_9474822 \|\| scaffold14851_4294229_SNP | 4294229 | A | G |
| S_9474974 \|\| scaffold14851_4295265_SNP | 4295265 | C | A |
| S_9474997 \|\| scaffold14851_4295756_SNP | 4295756 | C | A |
| S_9475005 \|\| scaffold14851_4295891_SNP | 4295891 | C | T |
| S_9475007 \|\| scaffold14851_4295895_SNP | 4295895 | T | A |
| S_9475010 \|\| scaffold14851_4295949_SNP | 4295949 | G | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9475065 \| \| scaffold14851_4296676_SNP | 4296676 | T | C |
| S_9475086 \| \| scaffold14851_4296872_SNP | 4296872 | A | C |
| S_9475089 \| \| scaffold14851_4296893_SNP | 4296893 | A | C |
| S_9475097 \| \| scaffold14851_4296978_SNP | 4296978 | C | A |
| S_9475107 \| \| scaffold14851_4297109_SNP | 4297109 | A | T |
| S_9475108 \| \| scaffold14851_4297112_SNP | 4297112 | A | C |
| S_9475126 \| \| scaffold14851_4297386_SNP | 4297386 | T | G |
| S_9475166 \| \| scaffold14851_4297758_SNP | 4297758 | C | T |
| S_9475334 \| \| scaffold14851_4299141_SNP | 4299141 | T | C |
| S_9475335 \| \| scaffold14851_4299167_SNP | 4299167 | A | T |
| S_9475337 \| \| scaffold14851_4299178_SNP | 4299178 | T | A |
| S_9475339 \| \| scaffold14851_4299280_SNP | 4299280 | G | A |
| S_9475341 \| \| scaffold14851_4299312_SNP | 4299312 | C | T |
| S_9475347 \| \| scaffold14851_4299379_SNP | 4299379 | G | A |
| S_9475350 \| \| scaffold14851_4299413_SNP | 4299413 | T | A |
| S_9475356 \| \| scaffold14851_4299495_SNP | 4299495 | T | A |
| S_9475499 \| \| scaffold14851_4300685_SNP | 4300685 | G | A |
| S_9475501 \| \| scaffold14851_4300699_SNP | 4300699 | C | T |
| S_9475661 \| \| scaffold14851_4302230_SNP | 4302230 | A | G |
| S_9475662 \| \| scaffold14851_4302234_SNP | 4302234 | G | A |
| S_9475669 \| \| scaffold14851_4302340_SNP | 4302340 | T | A |
| S_9475676 \| \| scaffold14851_4302516_SNP | 4302516 | G | C |
| S_9475677 \| \| scaffold14851_4302550_SNP | 4302550 | G | A |
| S_9475691 \| \| scaffold14851_4302795_SNP | 4302795 | A | T |
| S_9475692 \| \| scaffold14851_4302796_SNP | 4302796 | C | T |
| S_9475844 \| \| scaffold14851_4304063_SNP | 4304063 | A | T |
| S_9475849 \| \| scaffold14851_4304183_SNP | 4304183 | C | T |
| S_9475933 \| \| scaffold14851_4305486_SNP | 4305486 | T | G |
| S_9475985 \| \| scaffold14851_4306437_SNP | 4306437 | G | C |
| S_9476021 \| \| scaffold14851_4307396_SNP | 4307396 | T | G |
| S_9476159 \| \| scaffold14851_4309540_SNP | 4309540 | G | T |
| S_9476232 \| \| scaffold14851_4310678_SNP | 4310678 | A | G |
| S_9476367 \| \| scaffold14851_4312128_SNP | 4312128 | G | A |
| S_9476429 \| \| scaffold14851_4312719_SNP | 4312719 | G | A |
| S_9476495 \| \| scaffold14851_4313813_SNP | 4313813 | T | C |
| S_9476798 \| \| scaffold14851_4317135_SNP | 4317135 | G | A |
| S_9476843 \| \| scaffold14851_4317786_SNP | 4317786 | A | G |
| S_9476844 \| \| scaffold14851_4317791_SNP | 4317791 | G | T |
| S_9476845 \| \| scaffold14851_4317792_SNP | 4317792 | A | C |
| S_9476904 \| \| scaffold14851_4318304_SNP | 4318304 | C | G |
| S_9476953 \| \| scaffold14851_4319141_SNP | 4319141 | T | C |
| S_9477012 \| \| scaffold14851_4319691_SNP | 4319691 | T | C |
| S_9477014 \| \| scaffold14851_4319718_SNP | 4319718 | C | T |
| S_9477032 \| \| scaffold14851_4319829_SNP | 4319829 | G | T |
| S_9477059 \| \| scaffold14851_4320131_SNP | 4320131 | C | A |
| S_9477060 \| \| scaffold14851_4320151_SNP | 4320151 | G | A |
| S_9477064 \| \| scaffold14851_4320233_SNP | 4320233 | C | A |
| S_9477079 \| \| scaffold14851_4320419_SNP | 4320419 | G | C |
| S_9477105 \| \| scaffold14851_4320788_SNP | 4320788 | C | T |
| S_9477183 \| \| scaffold14851_4321506_SNP | 4321506 | A | T |
| S_9477199 \| \| scaffold14851_4321751_SNP | 4321751 | C | T |
| S_9477211 \| \| scaffold14851_4321957_SNP | 4321957 | T | A |
| S_9477214 \| \| scaffold14851_4322005_SNP | 4322005 | T | G |
| S_9477229 \| \| scaffold14851_4322280_SNP | 4322280 | A | C |
| S_9477231 \| \| scaffold14851_4322317_SNP | 4322317 | T | C |
| S_9477232 \| \| scaffold14851_4322319_SNP | 4322319 | A | C |
| S_9477246 \| \| scaffold14851_4322449_SNP | 4322449 | A | C |
| S_9477248 \| \| scaffold14851_4322472_SNP | 4322472 | T | G |
| S_9477249 \| \| scaffold14851_4322495_SNP | 4322495 | A | G |
| S_9477285 \| \| scaffold14851_4322879_SNP | 4322879 | C | T |
| S_9477321 \| \| scaffold14851_4323504_SNP | 4323504 | T | A |
| S_9477348 \| \| scaffold14851_4324016_SNP | 4324016 | G | A |
| S_9477354 \| \| scaffold14851_4324111_SNP | 4324111 | T | G |
| S_9477370 \| \| scaffold14851_4324391_SNP | 4324391 | C | T |
| S_9477376 \| \| scaffold14851_4324555_SNP | 4324555 | C | A |
| S_9477378 \| \| scaffold14851_4324570_SNP | 4324570 | C | T |
| S_9477379 \| \| scaffold14851_4324587_SNP | 4324587 | A | T |
| S_9477418 \| \| scaffold14851_4325114_SNP | 4325114 | T | G |
| S_9477424 \| \| scaffold14851_4325177_SNP | 4325177 | G | T |
| S_9477441 \| \| scaffold14851_4325377_SNP | 4325377 | T | C |
| S_9477451 \| \| scaffold14851_4325624_SNP | 4325624 | G | A |
| S_9477468 \| \| scaffold14851_4325881_SNP | 4325881 | T | C |
| S_9477480 \| \| scaffold14851_4325932_SNP | 4325932 | T | C |
| S_9477547 \| \| scaffold14851_4326721_SNP | 4326721 | G | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9477572 \| \| scaffold14851_4327068_SNP | 4327068 | G | A |
| S_9477584 \| \| scaffold14851_4327240_SNP | 4327240 | G | T |
| S_9477717 \| \| scaffold14851_4328309_SNP | 4328309 | C | A |
| S_9477758 \| \| scaffold14851_4328647_SNP | 4328647 | G | T |
| S_9477836 \| \| scaffold14851_4329539_SNP | 4329539 | A | C |
| S_9477864 \| \| scaffold14851_4330199_SNP | 4330199 | A | G |
| S_9477868 \| \| scaffold14851_4330283_SNP | 4330283 | A | T |
| S_9477920 \| \| scaffold14851_4330880_SNP | 4330880 | G | A |
| S_9477930 \| \| scaffold14851_4330994_SNP | 4330994 | T | G |
| S_9477936 \| \| scaffold14851_4331102_SNP | 4331102 | A | G |
| S_9477946 \| \| scaffold14851_4331204_SNP | 4331204 | G | T |
| S_9477958 \| \| scaffold14851_4331426_SNP | 4331426 | G | C |
| S_9478006 \| \| scaffold14851_4331931_SNP | 4331931 | G | T |
| S_9478007 \| \| scaffold14851_4331971_SNP | 4331971 | A | G |
| S_9478065 \| \| scaffold14851_4333462_SNP | 4333462 | G | T |
| S_9478068 \| \| scaffold14851_4333521_SNP | 4333521 | C | G |
| S_9478271 \| \| scaffold14851_4336437_SNP | 4336437 | A | T |
| S_9478272 \| \| scaffold14851_4336453_SNP | 4336453 | C | A |
| S_9478276 \| \| scaffold14851_4336507_SNP | 4336507 | G | C |
| S_9478291 \| \| scaffold14851_4336768_SNP | 4336768 | C | T |
| S_9478332 \| \| scaffold14851_4337199_SNP | 4337199 | T | C |
| S_9478570 \| \| scaffold14851_4340278_SNP | 4340278 | C | T |
| S_9478657 \| \| scaffold14851_4341490_SNP | 4341490 | G | A |
| S_9478676 \| \| scaffold14851_4341782_SNP | 4341782 | A | T |
| S_9478741 \| \| scaffold14851_4342332_SNP | 4342332 | G | A |
| S_9478743 \| \| scaffold14851_4342343_SNP | 4342343 | A | G |
| S_9478744 \| \| scaffold14851_4342345_SNP | 4342345 | T | C |
| S_9478750 \| \| scaffold14851_4342421_SNP | 4342421 | G | A |
| S_9478755 \| \| scaffold14851_4342487_SNP | 4342487 | G | A |
| S_9478756 \| \| scaffold14851_4342508_SNP | 4342508 | G | A |
| S_9478758 \| \| scaffold14851_4342529_SNP | 4342529 | T | C |
| S_9478765 \| \| scaffold14851_4342784_SNP | 4342784 | T | C |
| S_9478814 \| \| scaffold14851_4343468_SNP | 4343468 | G | T |
| S_9478817 \| \| scaffold14851_4343491_SNP | 4343491 | T | C |
| S_9478849 \| \| scaffold14851_4344126_SNP | 4344126 | C | T |
| S_9478877 \| \| scaffold14851_4344402_SNP | 4344402 | A | T |
| S_9478963 \| \| scaffold14851_4345420_SNP | 4345420 | T | C |
| S_9479026 \| \| scaffold14851_4345814_SNP | 4345814 | T | G |
| S_9479050 \| \| scaffold14851_4346122_SNP | 4346122 | T | C |
| S_9479094 \| \| scaffold14851_4346624_SNP | 4346624 | G | A |
| S_9479099 \| \| scaffold14851_4346818_SNP | 4346818 | A | C |
| S_9479104 \| \| scaffold14851_4346889_SNP | 4346889 | G | T |
| S_9479116 \| \| scaffold14851_4347086_SNP | 4347086 | T | A |
| S_9479122 \| \| scaffold14851_4347140_SNP | 4347140 | A | C |
| S_9479161 \| \| scaffold14851_4347879_SNP | 4347879 | T | G |
| S_9479245 \| \| scaffold14851_4349223_SNP | 4349223 | G | A |
| S_9479269 \| \| scaffold14851_4349511_SNP | 4349511 | G | A |
| S_9479271 \| \| scaffold14851_4349534_SNP | 4349534 | T | A |
| S_9479318 \| \| scaffold14851_4350145_SNP | 4350145 | C | A |
| S_9479357 \| \| scaffold14851_4351183_SNP | 4351183 | C | T |
| S_9479374 \| \| scaffold14851_4351490_SNP | 4351490 | T | A |
| S_9479379 \| \| scaffold14851_4351593_SNP | 4351593 | T | C |
| S_9479382 \| \| scaffold14851_4351688_SNP | 4351688 | G | T |
| S_9479404 \| \| scaffold14851_4352157_SNP | 4352157 | T | C |
| S_9479406 \| \| scaffold14851_4352164_SNP | 4352164 | C | T |
| S_9479407 \| \| scaffold14851_4352211_SNP | 4352211 | G | A |
| S_9479518 \| \| scaffold14851_4353287_SNP | 4353287 | A | T |
| S_9479529 \| \| scaffold14851_4353404_SNP | 4353404 | A | G |
| S_9479660 \| \| scaffold14851_4354804_SNP | 4354804 | T | C |
| S_9479678 \| \| scaffold14851_4355110_SNP | 4355110 | C | A |
| S_9479679 \| \| scaffold14851_4355124_SNP | 4355124 | G | C |
| S_9479689 \| \| scaffold14851_4355238_SNP | 4355238 | A | C |
| S_9479743 \| \| scaffold14851_4356137_SNP | 4356137 | T | G |
| S_9479795 \| \| scaffold14851_4356732_SNP | 4356732 | A | C |
| S_9479842 \| \| scaffold14851_4356803_SNP | 4356803 | T | A |
| S_9479858 \| \| scaffold14851_4357023_SNP | 4357023 | G | T |
| S_9479875 \| \| scaffold14851_4357273_SNP | 4357273 | G | T |
| S_9479877 \| \| scaffold14851_4357296_SNP | 4357296 | C | T |
| S_9479881 \| \| scaffold14851_4357322_SNP | 4357322 | G | A |
| S_9479886 \| \| scaffold14851_4357385_SNP | 4357385 | T | A |
| S_9480011 \| \| scaffold14851_4358702_SNP | 4358702 | G | T |
| S_9480101 \| \| scaffold14851_4359371_SNP | 4359371 | C | A |
| S_9480112 \| \| scaffold14851_4359534_SNP | 4359534 | T | C |
| S_9480176 \| \| scaffold14851_4361143_SNP | 4361143 | T | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9480211 \| \| scaffold14851_4361414_SNP | 4361414 | A | G |
| S_9480251 \| \| scaffold14851_4361977_SNP | 4361977 | G | T |
| S_9480258 \| \| scaffold14851_4362064_SNP | 4362064 | T | G |
| S_9480260 \| \| scaffold14851_4362128_SNP | 4362128 | T | A |
| S_9480288 \| \| scaffold14851_4362518_SNP | 4362518 | T | C |
| S_9480294 \| \| scaffold14851_4362621_SNP | 4362621 | C | G |
| S_9480335 \| \| scaffold14851_4362863_SNP | 4362863 | T | C |
| S_9480352 \| \| scaffold14851_4362881_SNP | 4362881 | T | C |
| S_9480400 \| \| scaffold14851_4363085_SNP | 4363085 | T | G |
| S_9480407 \| \| scaffold14851_4363132_SNP | 4363132 | T | A |
| S_9480408 \| \| scaffold14851_4363159_SNP | 4363159 | C | A |
| S_9480424 \| \| scaffold14851_4363436_SNP | 4363436 | G | T |
| S_9480425 \| \| scaffold14851_4363526_SNP | 4363526 | G | A |
| S_9480493 \| \| scaffold14851_4364539_SNP | 4364539 | G | T |
| S_9480495 \| \| scaffold14851_4364603_SNP | 4364603 | T | A |
| S_9480497 \| \| scaffold14851_4364619_SNP | 4364619 | G | T |
| S_9480548 \| \| scaffold14851_4365560_SNP | 4365560 | C | A |
| S_9480647 \| \| scaffold14851_4366520_SNP | 4366520 | G | T |
| S_9480665 \| \| scaffold14851_4366895_SNP | 4366895 | T | C |
| S_9480691 \| \| scaffold14851_4367340_SNP | 4367340 | T | C |
| S_9480702 \| \| scaffold14851_4367485_SNP | 4367485 | T | A |
| S_9480725 \| \| scaffold14851_4367764_SNP | 4367764 | T | A |
| S_9480727 \| \| scaffold14851_4367882_SNP | 4367882 | C | A |
| S_9480744 \| \| scaffold14851_4368062_SNP | 4368062 | G | T |
| S_9480746 \| \| scaffold14851_4368068_SNP | 4368068 | T | C |
| S_9480770 \| \| scaffold14851_4368115_SNP | 4368115 | C | G |
| S_9480848 \| \| scaffold14851_4368784_SNP | 4368784 | C | T |
| S_9480912 \| \| scaffold14851_4369562_SNP | 4369562 | G | A |
| S_9480922 \| \| scaffold14851_4369666_SNP | 4369666 | G | A |
| S_9480940 \| \| scaffold14851_4370115_SNP | 4370115 | G | T |
| S_9480942 \| \| scaffold14851_4370132_SNP | 4370132 | C | G |
| S_9480943 \| \| scaffold14851_4370133_SNP | 4370133 | T | G |
| S_9480948 \| \| scaffold14851_4370248_SNP | 4370248 | C | T |
| S_9480955 \| \| scaffold14851_4370327_SNP | 4370327 | G | A |
| S_9480956 \| \| scaffold14851_4370342_SNP | 4370342 | T | G |
| S_9481052 \| \| scaffold14851_4370948_SNP | 4370948 | G | A |
| S_9481097 \| \| scaffold14851_4371488_SNP | 4371488 | C | A |
| S_9481180 \| \| scaffold14851_4372793_SNP | 4372793 | C | G |
| S_9481182 \| \| scaffold14851_4372839_SNP | 4372839 | G | T |
| S_9481228 \| \| scaffold14851_4373499_SNP | 4373499 | T | C |
| S_9481260 \| \| scaffold14851_4373730_SNP | 4373730 | C | G |
| S_9481471 \| \| scaffold14851_4377529_SNP | 4377529 | A | G |
| S_9481614 \| \| scaffold14851_4379735_SNP | 4379735 | C | T |
| S_9481628 \| \| scaffold14851_4379996_SNP | 4379996 | A | G |
| S_9481640 \| \| scaffold14851_4380123_SNP | 4380123 | C | A |
| S_9481646 \| \| scaffold14851_4380237_SNP | 4380237 | C | G |
| S_9481736 \| \| scaffold14851_4381597_SNP | 4381597 | C | A |
| S_9481737 \| \| scaffold14851_4381603_SNP | 4381603 | G | T |
| S_9481980 \| \| scaffold14851_4384483_SNP | 4384483 | C | T |
| S_9481988 \| \| scaffold14851_4384514_SNP | 4384514 | C | T |
| S_9482052 \| \| scaffold14851_4384626_SNP | 4384626 | C | G |
| S_9482055 \| \| scaffold14851_4384627_SNP | 4384627 | G | T |
| S_9482067 \| \| scaffold14851_4384867_SNP | 4384867 | A | T |
| S_9482074 \| \| scaffold14851_4384911_SNP | 4384911 | T | C |
| S_9482120 \| \| scaffold14851_4385664_SNP | 4385664 | G | A |
| S_9482141 \| \| scaffold14851_4385937_SNP | 4385937 | T | A |
| S_9482142 \| \| scaffold14851_4385938_SNP | 4385938 | T | C |
| S_9482168 \| \| scaffold14851_4386448_SNP | 4386448 | T | C |
| S_9482179 \| \| scaffold14851_4386515_SNP | 4386515 | G | C |
| S_9482233 \| \| scaffold14851_4386884_SNP | 4386884 | A | G |
| S_9482237 \| \| scaffold14851_4386942_SNP | 4386942 | A | T |
| S_9482314 \| \| scaffold14851_4387756_SNP | 4387756 | C | G |
| S_9482319 \| \| scaffold14851_4388053_SNP | 4388053 | C | A |
| S_9482361 \| \| scaffold14851_4388491_SNP | 4388491 | C | G |
| S_9482362 \| \| scaffold14851_4388509_SNP | 4388509 | A | G |
| S_9482382 \| \| scaffold14851_4388722_SNP | 4388722 | G | A |
| S_9482389 \| \| scaffold14851_4388830_SNP | 4388830 | C | T |
| S_9482390 \| \| scaffold14851_4388867_SNP | 4388867 | T | C |
| S_9482406 \| \| scaffold14851_4389160_SNP | 4389160 | G | A |
| S_9482579 \| \| scaffold14851_4391585_SNP | 4391585 | G | A |
| S_9482619 \| \| scaffold14851_4392257_SNP | 4392257 | G | T |
| S_9482629 \| \| scaffold14851_4392412_SNP | 4392412 | G | A |
| S_9482783 \| \| scaffold14851_4394566_SNP | 4394566 | A | G |
| S_9482818 \| \| scaffold14851_4394986_SNP | 4394986 | T | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9482886 \| \| scaffold14851_4395692_SNP | 4395692 | A | G |
| S_9482927 \| \| scaffold14851_4396025_SNP | 4396025 | T | C |
| S_9483177 \| \| scaffold14851_4398838_SNP | 4398838 | G | C |
| S_9483253 \| \| scaffold14851_4399656_SNP | 4399656 | A | G |
| S_9483361 \| \| scaffold14851_4400924_SNP | 4400924 | A | C |
| S_9483414 \| \| scaffold14851_4401365_SNP | 4401365 | T | C |
| S_9483431 \| \| scaffold14851_4401583_SNP | 4401583 | T | G |
| S_9483457 \| \| scaffold14851_4402117_SNP | 4402117 | C | A |
| S_9483502 \| \| scaffold14851_4402678_SNP | 4402678 | T | G |
| S_9483599 \| \| scaffold14851_4403879_SNP | 4403879 | T | C |
| S_9483846 \| \| scaffold14851_4408336_SNP | 4408336 | T | A |
| S_9483896 \| \| scaffold14851_4409004_SNP | 4409004 | T | C |
| S_9483897 \| \| scaffold14851_4409046_SNP | 4409046 | C | G |
| S_9483903 \| \| scaffold14851_4409127_SNP | 4409127 | A | G |
| S_9483957 \| \| scaffold14851_4409528_SNP | 4409528 | A | G |
| S_9483965 \| \| scaffold14851_4409603_SNP | 4409603 | A | G |
| S_9484075 \| \| scaffold14851_4410867_SNP | 4410867 | G | A |
| S_9484096 \| \| scaffold14851_4411036_SNP | 4411036 | A | C |
| S_9484212 \| \| scaffold14851_4412522_SNP | 4412522 | T | C |
| S_9484214 \| \| scaffold14851_4412578_SNP | 4412578 | T | G |
| S_9484219 \| \| scaffold14851_4412624_SNP | 4412624 | T | A |
| S_9484220 \| \| scaffold14851_4412638_SNP | 4412638 | A | C |
| S_9484321 \| \| scaffold14851_4414127_SNP | 4414127 | T | G |
| S_9484351 \| \| scaffold14851_4414582_SNP | 4414582 | T | A |
| S_9484382 \| \| scaffold14851_4415018_SNP | 4415018 | G | A |
| S_9484389 \| \| scaffold14851_4415168_SNP | 4415168 | T | A |
| S_9484433 \| \| scaffold14851_4415568_SNP | 4415568 | T | G |
| S_9484564 \| \| scaffold14851_4417852_SNP | 4417852 | C | A |
| S_9484591 \| \| scaffold14851_4418165_SNP | 4418165 | C | G |
| S_9484650 \| \| scaffold14851_4418598_SNP | 4418598 | C | T |
| S_9484760 \| \| scaffold14851_4419614_SNP | 4419614 | G | A |
| S_9484797 \| \| scaffold14851_4420098_SNP | 4420098 | T | C |
| S_9484812 \| \| scaffold14851_4420492_SNP | 4420492 | T | G |
| S_9484852 \| \| scaffold14851_4421049_SNP | 4421049 | A | T |
| S_9484855 \| \| scaffold14851_4421058_SNP | 4421058 | T | C |
| S_9484959 \| \| scaffold14851_4422287_SNP | 4422287 | T | C |
| S_9484963 \| \| scaffold14851_4422370_SNP | 4422370 | A | G |
| S_9484967 \| \| scaffold14851_4422406_SNP | 4422406 | C | T |
| S_9484968 \| \| scaffold14851_4422409_SNP | 4422409 | T | C |
| S_9484973 \| \| scaffold14851_4422437_SNP | 4422437 | A | G |
| S_9484983 \| \| scaffold14851_4422568_SNP | 4422568 | C | G |
| S_9485198 \| \| scaffold14851_4425487_SNP | 4425487 | G | A |
| S_9485283 \| \| scaffold14851_4426425_SNP | 4426425 | A | C |
| S_9485296 \| \| scaffold14851_4426705_SNP | 4426705 | G | A |
| S_9485298 \| \| scaffold14851_4426717_SNP | 4426717 | G | T |
| S_9485340 \| \| scaffold14851_4427351_SNP | 4427351 | A | T |
| S_9485344 \| \| scaffold14851_4427420_SNP | 4427420 | G | A |
| S_9485346 \| \| scaffold14851_4427462_SNP | 4427462 | G | T |
| S_9485347 \| \| scaffold14851_4427486_SNP | 4427486 | T | A |
| S_9485381 \| \| scaffold14851_4428316_SNP | 4428316 | T | G |
| S_9485397 \| \| scaffold14851_4428522_SNP | 4428522 | C | A |
| S_9485506 \| \| scaffold14851_4430012_SNP | 4430012 | C | A |
| S_9485543 \| \| scaffold14851_4430399_SNP | 4430399 | T | G |
| S_9485563 \| \| scaffold14851_4430794_SNP | 4430794 | G | A |
| S_9485689 \| \| scaffold14851_4432937_SNP | 4432937 | A | C |
| S_9485717 \| \| scaffold14851_4433362_SNP | 4433362 | G | A |
| S_9485791 \| \| scaffold14851_4434194_SNP | 4434194 | T | C |
| S_9485799 \| \| scaffold14851_4434430_SNP | 4434430 | A | G |
| S_9485831 \| \| scaffold14851_4434652_SNP | 4434652 | G | T |
| S_9485886 \| \| scaffold14851_4435081_SNP | 4435081 | C | T |
| S_9485887 \| \| scaffold14851_4435123_SNP | 4435123 | C | A |
| S_9485937 \| \| scaffold14851_4435962_SNP | 4435962 | T | G |
| S_9485941 \| \| scaffold14851_4435993_SNP | 4435993 | T | A |
| S_9485942 \| \| scaffold14851_4436018_SNP | 4436018 | C | T |
| S_9485943 \| \| scaffold14851_4436026_SNP | 4436026 | C | T |
| S_9485945 \| \| scaffold14851_4436057_SNP | 4436057 | A | G |
| S_9485946 \| \| scaffold14851_4436067_SNP | 4436067 | G | A |
| S_9485986 \| \| scaffold14851_4436555_SNP | 4436555 | C | T |
| S_9486012 \| \| scaffold14851_4436736_SNP | 4436736 | A | T |
| S_9486068 \| \| scaffold14851_4437349_SNP | 4437349 | G | C |
| S_9486111 \| \| scaffold14851_4437810_SNP | 4437810 | T | C |
| S_9486155 \| \| scaffold14851_4438197_SNP | 4438197 | T | C |
| S_9486205 \| \| scaffold14851_4438732_SNP | 4438732 | G | C |
| S_9486232 \| \| scaffold14851_4438909_SNP | 4438909 | T | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9486285 \| \| scaffold14851_4439886_SNP | 4439886 | A | G |
| $_9486302 \| \| scaffold14851_4440148_SNP | 4440148 | G | A |
| S_9486401 \| \| scaffold14851_4441412_SNP | 4441412 | T | C |
| S_9486402 \| \| scaffold14851_4441416_SNP | 4441416 | A | C |
| S_9486495 \| \| scaffold14851_4442161_SNP | 4442161 | A | G |
| S_9486573 \| \| scaffold14851_4442642_SNP | 4442642 | A | T |
| S_9486588 \| \| scaffold14851_4442905_SNP | 4442905 | G | T |
| S_9486660 \| \| scaffold14851_4444410_SNP | 4444410 | T | A |
| S_9486680 \| \| scaffold14851_4444821_SNP | 4444821 | A | G |
| S_9486729 \| \| scaffold14851_4445528_SNP | 4445528 | G | A |
| S_9486810 \| \| scaffold14851_4446308_SNP | 4446308 | G | A |
| S_9486811 \| \| scaffold14851_4446313_SNP | 4446313 | G | A |
| S_9486814 \| \| scaffold14851_4446416_SNP | 4446416 | C | A |
| S_9486857 \| \| scaffold14851_4447109_SNP | 4447109 | G | A |
| S_9486870 \| \| scaffold14851_4447527_SNP | 4447527 | C | T |
| S_9486930 \| \| scaffold14851_4448283_SNP | 4448283 | A | T |
| S_9486932 \| \| scaffold14851_4448294_SNP | 4448294 | G | A |
| S_9487068 \| \| scaffold14851_4450234_SNP | 4450234 | G | C |
| S_9487089 \| \| scaffold14851_4450610_SNP | 4450610 | G | A |
| S_9487134 \| \| scaffold14851_4450804_SNP | 4450804 | A | T |
| S_9487207 \| \| scaffold14851_4451983_SNP | 4451983 | A | G |
| S_9487273 \| \| scaffold14851_4453219_SNP | 4453219 | T | C |
| S_9487276 \| \| scaffold14851_4453273_SNP | 4453273 | C | T |
| S_9487364 \| \| scaffold14851_4454488_SNP | 4454488 | C | T |
| S_9487510 \| \| scaffold14851_4456489_SNP | 4456489 | A | G |
| S_9487528 \| \| scaffold14851_4456918_SNP | 4456918 | T | G |
| S_9487536 \| \| scaffold14851_4457098_SNP | 4457098 | T | C |
| S_9487538 \| \| scaffold14851_4457119_SNP | 4457119 | C | T |
| S_9487539 \| \| scaffold14851_4457133_SNP | 4457133 | G | T |
| S_9487648 \| \| scaffold14851_4458787_SNP | 4458787 | T | C |
| S_9487650 \| \| scaffold14851_4458842_SNP | 4458842 | G | T |
| S_9487652 \| \| scaffold14851_4458879_SNP | 4458879 | G | A |
| S_9487657 \| \| scaffold14851_4458935_SNP | 4458935 | T | G |
| S_9487665 \| \| scaffold14851_4459022_SNP | 4459022 | A | G |
| S_9487678 \| \| scaffold14851_4459142_SNP | 4459142 | A | G |
| S_9487904 \| \| scaffold14851_4461052_SNP | 4461052 | A | T |
| S_9487906 \| \| scaffold14851_4461092_SNP | 4461092 | A | C |
| S_9487914 \| \| scaffold14851_4461192_SNP | 4461192 | G | A |
| S_9487915 \| \| scaffold14851_4461217_SNP | 4461217 | C | G |
| S_9487916 \| \| scaffold14851_4461223_SNP | 4461223 | A | G |
| S_9487967 \| \| scaffold14851_4461877_SNP | 4461877 | C | T |
| S_9487987 \| \| scaffold14851_4462282_SNP | 4462282 | G | T |
| S_9488023 \| \| scaffold14851_4462640_SNP | 4462640 | G | A |
| S_9488370 \| \| scaffold14851_4467850_SNP | 4467850 | A | C |
| S_9488394 \| \| scaffold14851_4467987_SNP | 4467987 | G | A |
| S_9488397 \| \| scaffold14851_4468027_SNP | 4468027 | A | T |
| S_9488485 \| \| scaffold14851_4469303_SNP | 4469303 | T | G |
| S_9488486 \| \| scaffold14851_4469304_SNP | 4469304 | C | T |
| S_9488541 \| \| scaffold14851_4469900_SNP | 4469900 | T | G |
| S_9488543 \| \| scaffold14851_4469927_SNP | 4469927 | C | A |
| S_9488548 \| \| scaffold14851_4469970_SNP | 4469970 | T | G |
| S_9488549 \| \| scaffold14851_4469974_SNP | 4469974 | C | T |
| S_9488573 \| \| scaffold14851_4470160_SNP | 4470160 | A | T |
| S_9488584 \| \| scaffold14851_4470325_SNP | 4470325 | C | T |
| S_9488636 \| \| scaffold14851_4471345_SNP | 4471345 | G | T |
| S_9488638 \| \| scaffold14851_4471350_SNP | 4471350 | T | G |
| S_9488640 \| \| scaffold14851_4471411_SNP | 4471411 | A | G |
| S_9488679 \| \| scaffold14851_4471807_SNP | 4471807 | G | A |
| S_9488918 \| \| scaffold14851_4473775_SNP | 4473775 | T | A |
| S_9488938 \| \| scaffold14851_4474008_SNP | 4474008 | G | A |
| S_9488983 \| \| scaffold14851_4474673_SNP | 4474673 | G | A |
| S_9488986 \| \| scaffold14851_4474737_SNP | 4474737 | G | A |
| S_9489018 \| \| scaffold14851_4475049_SNP | 4475049 | A | G |
| S_9489019 \| \| scaffold14851_4475051_SNP | 4475051 | A | G |
| S_9489033 \| \| scaffold14851_4475138_SNP | 4475138 | G | A |
| S_9489036 \| \| scaffold14851_4475156_SNP | 4475156 | G | A |
| S_9489037 \| \| scaffold14851_4475158_SNP | 4475158 | A | G |
| S_9489040 \| \| scaffold14851_4475200_SNP | 4475200 | A | G |
| S_9489041 \| \| scaffold14851_4475214_SNP | 4475214 | G | A |
| S_9489048 \| \| scaffold14851_4475468_SNP | 4475468 | T | C |
| S_9489308 \| \| scaffold14851_4479562_SNP | 4479562 | T | A |
| S_9489604 \| \| scaffold14851_4482173_SNP | 4482173 | G | A |
| S_9489607 \| \| scaffold14851_4482211_SNP | 4482211 | A | G |
| S_9489747 \| \| scaffold14851_4483989_SNP | 4483989 | T | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9489777 \| \| scaffold14851_4484468_SNP | 4484468 | T | A |
| S_9489781 \| \| scaffold14851_4484516_SNP | 4484516 | C | T |
| S_9489782 \| \| scaffold14851_4484519_SNP | 4484519 | C | T |
| S_9489838 \| \| scaffold14851_4485717_SNP | 4485717 | C | G |
| S_9489996 \| \| scaffold14851_4488212_SNP | 4488212 | A | C |
| S_9490039 \| \| scaffold14851_4488849_SNP | 4488849 | T | A |
| S_9490096 \| \| scaffold14851_4489713_SNP | 4489713 | C | A |
| S_9490115 \| \| scaffold14851_4490060_SNP | 4490060 | C | G |
| S_9490117 \| \| scaffold14851_4490096_SNP | 4490096 | T | C |
| S_9490130 \| \| scaffold14851_4490171_SNP | 4490171 | A | G |
| S_9490253 \| \| scaffold14851_4491170_SNP | 4491170 | G | A |
| S_9490255 \| \| scaffold14851_4491183_SNP | 4491183 | A | G |
| S_9490285 \| \| scaffold14851_4491530_SNP | 4491530 | C | T |
| S_9490311 \| \| scaffold14851_4491805_SNP | 4491805 | C | T |
| S_9490350 \| \| scaffold14851_4492438_SNP | 4492438 | A | G |
| S_9490351 \| \| scaffold14851_4492487_SNP | 4492487 | G | A |
| S_9490371 \| \| scaffold14851_4492837_SNP | 4492837 | T | A |
| S_9490372 \| \| scaffold14851_4492867_SNP | 4492867 | A | G |
| S_9490377 \| \| scaffold14851_4492962_SNP | 4492962 | G | A |
| S_9490494 \| \| scaffold14851_4495027_SNP | 4495027 | T | A |
| S_9491051 \| \| scaffold14851_4501715_SNP | 4501715 | A | G |
| S_9491056 \| \| scaffold14851_4501787_SNP | 4501787 | A | C |
| S_9491098 \| \| scaffold14851_4502533_SNP | 4502533 | G | A |
| S_9491100 \| \| scaffold14851_4502603_SNP | 4502603 | A | G |
| S_9491387 \| \| scaffold14851_4506125_SNP | 4506125 | G | A |
| S_9491388 \| \| scaffold14851_4506126_SNP | 4506126 | A | C |
| S_9491469 \| \| scaffold14851_4506765_SNP | 4506765 | A | G |
| S_9491554 \| \| scaffold14851_4507898_SNP | 4507898 | C | T |
| S_9491772 \| \| scaffold14851_4511068_SNP | 4511068 | C | G |
| S_9491779 \| \| scaffold14851_4511219_SNP | 4511219 | T | A |
| S_9491840 \| \| scaffold14851_4512163_SNP | 4512163 | C | G |
| S_9491842 \| \| scaffold14851_4512192_SNP | 4512192 | T | C |
| S_9491843 \| \| scaffold14851_4512200_SNP | 4512200 | T | C |
| S_9491845 \| \| scaffold14851_4512218_SNP | 4512218 | T | C |
| S_9491907 \| \| scaffold14851_4512947_SNP | 4512947 | G | A |
| S_9491984 \| \| scaffold14851_4514645_SNP | 4514645 | G | A |
| S_9492028 \| \| scaffold14851_4515620_SNP | 4515620 | T | C |
| S_9492083 \| \| scaffold14851_4516202_SNP | 4516202 | C | T |
| S_9492100 \| \| scaffold14851_4516403_SNP | 4516403 | C | T |
| S_9492165 \| \| scaffold14851_4517470_SNP | 4517470 | G | T |
| S_9492172 \| \| scaffold14851_4517538_SNP | 4517538 | G | A |
| S_9492280 \| \| scaffold14851_4518757_SNP | 4518757 | A | G |
| S_9492281 \| \| scaffold14851_4518759_SNP | 4518759 | G | A |
| S_9492401 \| \| scaffold14851_4520272_SNP | 4520272 | T | A |
| S_9492509 \| \| scaffold14851_4522101_SNP | 4522101 | G | T |
| S_9492527 \| \| scaffold14851_4522288_SNP | 4522288 | G | A |
| S_9492553 \| \| scaffold14851_4522632_SNP | 4522632 | T | C |
| S_9492790 \| \| scaffold14851_4525368_SNP | 4525368 | A | C |
| S_9492791 \| \| scaffold14851_4525370_SNP | 4525370 | G | A |
| S_9492879 \| \| scaffold14851_4526026_SNP | 4526026 | G | C |
| S_9492906 \| \| scaffold14851_4526409_SNP | 4526409 | T | C |
| S_9492930 \| \| scaffold14851_4526707_SNP | 4526707 | A | G |
| scaffold14851_4526771_SNP | 4526771 | A | G |
| scaffold14851_4527151_SNP | 4527151 | C | A |
| S_9493037 \| \| scaffold14851_4527158_SNP | 4527158 | A | G |
| S_9493950 \| \| scaffold14851_4541150_SNP | 4541150 | G | A |
| S_9493965 \| \| scaffold14851_4541543_SNP | 4541543 | G | C |
| S_9494055 \| \| scaffold14851_4542558_SNP | 4542558 | A | C |
| S_9494102 \| \| scaffold14851_4543196_SNP | 4543196 | A | T |
| S_9494155 \| \| scaffold14851_4543982_SNP | 4543982 | G | A |
| S_9494270 \| \| scaffold14851_4545268_SNP | 4545268 | T | C |
| S_9494334 \| \| scaffold14851_4545777_SNP | 4545777 | T | C |
| S_9494385 \| \| scaffold14851_4546397_SNP | 4546397 | G | A |
| S_9494425 \| \| scaffold14851_4546911_SNP | 4546911 | T | C |
| S_9494476 \| \| scaffold14851_4547172_SNP | 4547172 | T | C |
| S_9494487 \| \| scaffold14851_4547245_SNP | 4547245 | G | A |
| S_9494643 \| \| scaffold14851_4549269_SNP | 4549269 | C | T |
| S_9494644 \| \| scaffold14851_4549274_SNP | 4549274 | T | C |
| S_9494661 \| \| scaffold14851_4549501_SNP | 4549501 | C | A |
| S_9494668 \| \| scaffold14851_4549671_SNP | 4549671 | A | C |
| S_9494693 \| \| scaffold14851_4549876_SNP | 4549876 | T | C |
| S_9494764 \| \| scaffold14851_4550548_SNP | 4550548 | T | C |
| S_9494774 \| \| scaffold14851_4550606_SNP | 4550606 | A | G |
| S_9494798 \| \| scaffold14851_4550855_SNP | 4550855 | G | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9494800 \| \| scaffold14851_4550868_SNP | 4550868 | C | T |
| S_9494807 \| \| scaffold14851_4550944_SNP | 4550944 | G | T |
| S_9494812 \| \| scaffold14851_4550981_SNP | 4550981 | T | C |
| S_9494853 \| \| scaffold14851_4551649_SNP | 4551649 | C | A |
| S_9494854 \| \| scaffold14851_4551659_SNP | 4551659 | T | C |
| S_9494856 \| \| scaffold14851_4551678_SNP | 4551678 | A | G |
| S_9494872 \| \| scaffold14851_4551854_SNP | 4551854 | G | A |
| S_9494877 \| \| scaffold14851_4551909_SNP | 4551909 | C | T |
| S_9494913 \| \| scaffold14851_4552387_SNP | 4552387 | G | T |
| S_9494928 \| \| scaffold14851_4552558_SNP | 4552558 | G | T |
| S_9495017 \| \| scaffold14851_4553256_SNP | 4553256 | A | C |
| S_9495047 \| \| scaffold14851_4553634_SNP | 4553634 | C | A |
| S_9495061 \| \| scaffold14851_4553783_SNP | 4553783 | C | T |
| S_9495063 \| \| scaffold14851_4553824_SNP | 4553824 | C | T |
| S_9495065 \| \| scaffold14851_4553921_SNP | 4553921 | A | T |
| S_9495066 \| \| scaffold14851_4553922_SNP | 4553922 | T | A |
| S_9495106 \| \| scaffold14851_4555068_SNP | 4555068 | G | A |
| S_9495108 \| \| scaffold14851_4555089_SNP | 4555089 | A | C |
| S_9495110 \| \| scaffold14851_4555135_SNP | 4555135 | A | C |
| S_9495112 \| \| scaffold14851_4555183_SNP | 4555183 | C | T |
| S_9495116 \| \| scaffold14851_4555246_SNP | 4555246 | A | C |
| S_9495117 \| \| scaffold14851_4555253_SNP | 4555253 | T | A |
| S_9495161 \| \| scaffold14851_4555720_SNP | 4555720 | C | T |
| S_9495192 \| \| scaffold14851_4556056_SNP | 4556056 | G | A |
| S_9495193 \| \| scaffold14851_4556079_SNP | 4556079 | T | A |
| S_9495223 \| \| scaffold14851_4556418_SNP | 4556418 | C | T |
| S_9495224 \| \| scaffold14851_4556467_SNP | 4556467 | A | G |
| S_9495234 \| \| scaffold14851_4556698_SNP | 4556698 | T | G |
| S_9495551 \| \| scaffold14851_4560725_SNP | 4560725 | C | T |
| S_9495686 \| \| scaffold14851_4561438_SNP | 4561438 | C | T |
| S_9495702 \| \| scaffold14851_4561668_SNP | 4561668 | A | C |
| S_9495711 \| \| scaffold14851_4561774_SNP | 4561774 | C | T |
| S_9495765 \| \| scaffold14851_4562805_SNP | 4562805 | G | C |
| S_9495863 \| \| scaffold14851_4563908_SNP | 4563908 | A | C |
| S_9495943 \| \| scaffold14851_4565031_SNP | 4565031 | A | T |
| S_9495976 \| \| scaffold14851_4565570_SNP | 4565570 | T | G |
| S_9496001 \| \| scaffold14851_4566052_SNP | 4566052 | C | G |
| S_9496006 \| \| scaffold14851_4566152_SNP | 4566152 | T | G |
| S_9496009 \| \| scaffold14851_4566318_SNP | 4566318 | T | A |
| S_9496017 \| \| scaffold14851_4566468_SNP | 4566468 | G | A |
| S_9496034 \| \| scaffold14851_4566804_SNP | 4566804 | A | G |
| S_9496036 \| \| scaffold14851_4566822_SNP | 4566822 | T | A |
| S_9496110 \| \| scaffold14851_4568362_SNP | 4568362 | C | G |
| S_9496302 \| \| scaffold14851_4571912_SNP | 4571912 | A | T |
| S_9496614 \| \| scaffold14851_4583123_SNP | 4583123 | G | A |
| S_9496618 \| \| scaffold14851_4583191_SNP | 4583191 | C | T |
| S_9496627 \| \| scaffold14851_4583422_SNP | 4583422 | C | T |
| S_9496718 \| \| scaffold14851_4585210_SNP | 4585210 | G | C |
| S_9496892 \| \| scaffold14851_4588146_SNP | 4588146 | T | C |
| S_9496980 \| \| scaffold14851_4589623_SNP | 4589623 | A | G |
| S_9497066 \| \| scaffold14851_4590460_SNP | 4590460 | T | A |
| S_9497248 \| \| scaffold14851_4592808_SNP | 4592808 | T | A |
| S_9497259 \| \| scaffold14851_4593019_SNP | 4593019 | C | A |
| S_9497465 \| \| scaffold14851_4594695_SNP | 4594695 | T | A |
| S_9497500 \| \| scaffold14851_4595284_SNP | 4595284 | C | T |
| S_9497633 \| \| scaffold14851_4596936_SNP | 4596936 | T | A |
| S_9497850 \| \| scaffold14851_4600220_SNP | 4600220 | G | C |
| S_9497870 \| \| scaffold14851_4600456_SNP | 4600456 | T | A |
| S_9497959 \| \| scaffold14851_4601511_SNP | 4601511 | A | G |
| S_9497978 \| \| scaffold14851_4601778_SNP | 4601778 | C | T |
| S_9498002 \| \| scaffold14851_4602102_SNP | 4602102 | T | C |
| S_9498083 \| \| scaffold14851_4602620_SNP | 4602620 | T | C |
| scaffold14851_4602697_SNP | 4602697 | C | T |
| S_9498112 \| \| scaffold14851_4602795_SNP | 4602795 | G | T |
| S_9498283 \| \| scaffold14851_4603386_SNP | 4603386 | T | A |
| S_9498292 \| \| scaffold14851_4603432_SNP | 4603432 | T | C |
| S_9498329 \| \| scaffold14851_4604651_SNP | 4604651 | C | T |
| S_9498330 \| \| scaffold14851_4604658_SNP | 4604658 | A | G |
| S_9498334 \| \| scaffold14851_4604778_SNP | 4604778 | A | G |
| S_9498374 \| \| scaffold14851_4605476_SNP | 4605476 | C | A |
| S_9498432 \| \| scaffold14851_4606655_SNP | 4606655 | G | A |
| S_9498434 \| \| scaffold14851_4606691_SNP | 4606691 | A | G |
| S_9498606 \| \| scaffold14851_4609060_SNP | 4609060 | T | G |
| S_9498746 \| \| scaffold14851_4610689_SNP | 4610689 | G | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9499096 \| \| scaffold14851_4615817_SNP | 4615817 | T | G |
| S_9499099 \| \| scaffold14851_4615834_SNP | 4615834 | A | G |
| S_9499330 \| \| scaffold14851_4619189_SNP | 4619189 | A | G |
| S_9499440 \| \| scaffold14851_4620661_SNP | 4620661 | T | C |
| S_9499767 \| \| scaffold14851_4624476_SNP | 4624476 | A | C |
| S_9499820 \| \| scaffold14851_4624948_SNP | 4624948 | C | A |
| S_9499904 \| \| scaffold14851_4625585_SNP | 4625585 | G | A |
| S_9499907 \| \| scaffold14851_4625612_SNP | 4625612 | A | G |
| S_9500116 \| \| scaffold14851_4628566_SNP | 4628566 | T | C |
| S_9500278 \| \| scaffold14851_4630468_SNP | 4630468 | C | T |
| S_9500285 \| \| scaffold14851_4630508_SNP | 4630508 | C | T |
| S_9500291 \| \| scaffold14851_4630588_SNP | 4630588 | T | C |
| S_9500307 \| \| scaffold14851_4630784_SNP | 4630784 | A | G |
| S_9500309 \| \| scaffold14851_4630792_SNP | 4630792 | C | T |
| S_9500315 \| \| scaffold14851_4630840_SNP | 4630840 | A | G |
| S_9500317 \| \| scaffold14851_4630850_SNP | 4630850 | G | A |
| S_9500318 \| \| scaffold14851_4630852_SNP | 4630852 | A | G |
| S_9500398 \| \| scaffold14851_4631548_SNP | 4631548 | G | T |
| S_9500404 \| \| scaffold14851_4631680_SNP | 4631680 | G | A |
| S_9500472 \| \| scaffold14851_4632603_SNP | 4632603 | G | A |
| S_9500524 \| \| scaffold14851_4633397_SNP | 4633397 | A | G |
| S_9500642 \| \| scaffold14851_4635219_SNP | 4635219 | A | G |
| S_9500754 \| \| scaffold14851_4636638_SNP | 4636638 | G | A |
| S_9500772 \| \| scaffold14851_4636768_SNP | 4636768 | G | C |
| S_9500794 \| \| scaffold14851_4637112_SNP | 4637112 | C | T |
| S_9500798 \| \| scaffold14851_4637161_SNP | 4637161 | A | G |
| S_9500994 \| \| scaffold14851_4639575_SNP | 4639575 | A | C |
| S_9501299 \| \| scaffold14851_4644461_SNP | 4644461 | T | C |
| S_9501330 \| \| scaffold14851_4644827_SNP | 4644827 | C | A |
| S_9501396 \| \| scaffold14851_4645720_SNP | 4645720 | C | T |
| S_9501495 \| \| scaffold14851_4647361_SNP | 4647361 | T | G |
| S_9501533 \| \| scaffold14851_4647914_SNP | 4647914 | A | T |
| S_9501732 \| \| scaffold14851_4650042_SNP | 4650042 | A | T |
| S_9501746 \| \| scaffold14851_4650312_SNP | 4650312 | A | T |
| S_9501748 \| \| scaffold14851_4650342_SNP | 4650342 | C | A |
| S_9501879 \| \| scaffold14851_4652762_SNP | 4652762 | A | T |
| S_9502276 \| \| scaffold14851_4657636_SNP | 4657636 | C | A |
| S_9502474 \| \| scaffold14851_4659937_SNP | 4659937 | C | G |
| S_9502511 \| \| scaffold14851_4660477_SNP | 4660477 | A | T |
| S_9502558 \| \| scaffold14851_4661046_SNP | 4661046 | T | C |
| S_9502677 \| \| scaffold14851_4662271_SNP | 4662271 | C | T |
| S_9502855 \| \| scaffold14851_4666570_SNP | 4666570 | G | A |
| S_9502859 \| \| scaffold14851_4666594_SNP | 4666594 | A | G |
| S_9502863 \| \| scaffold14851_4666639_SNP | 4666639 | A | C |
| S_9502927 \| \| scaffold14851_4667746_SNP | 4667746 | T | G |
| S_9502956 \| \| scaffold14851_4668054_SNP | 4668054 | T | A |
| S_9502984 \| \| scaffold14851_4668366_SNP | 4668366 | A | T |
| S_9503265 \| \| scaffold14851_4672017_SNP | 4672017 | A | C |
| S_9503341 \| \| scaffold14851_4672876_SNP | 4672876 | G | A |
| S_9503389 \| \| scaffold14851_4673486_SNP | 4673486 | A | G |
| S_9503397 \| \| scaffold14851_4673702_SNP | 4673702 | A | C |
| S_9503408 \| \| scaffold14851_4673854_SNP | 4673854 | A | G |
| S_9503409 \| \| scaffold14851_4673876_SNP | 4673876 | A | G |
| S_9503410 \| \| scaffold14851_4673885_SNP | 4673885 | A | G |
| S_9503439 \| \| scaffold14851_4674069_SNP | 4674069 | A | G |
| S_9503639 \| \| scaffold14851_4676268_SNP | 4676268 | T | A |
| S_9503644 \| \| scaffold14851_4676391_SNP | 4676391 | G | A |
| S_9503694 \| \| scaffold14851_4677137_SNP | 4677137 | C | G |
| S_9503716 \| \| scaffold14851_4677484_SNP | 4677484 | A | C |
| S_9503783 \| \| scaffold14851_4678818_SNP | 4678818 | G | A |
| S_9503868 \| \| scaffold14851_4680027_SNP | 4680027 | A | G |
| S_9503982 \| \| scaffold14851_4681132_SNP | 4681132 | G | C |
| S_9503996 \| \| scaffold14851_4681204_SNP | 4681204 | C | T |
| S_9504029 \| \| scaffold14851_4681452_SNP | 4681452 | A | G |
| S_9504114 \| \| scaffold14851_4682566_SNP | 4682566 | A | G |
| S_9504128 \| \| scaffold14851_4682719_SNP | 4682719 | T | C |
| S_9504150 \| \| scaffold14851_4682930_SNP | 4682930 | G | A |
| S_9504170 \| \| scaffold14851_4683209_SNP | 4683209 | C | T |
| S_9504237 \| \| scaffold14851_4683971_SNP | 4683971 | C | T |
| S_9504254 \| \| scaffold14851_4684106_SNP | 4684106 | T | C |
| S_9504355 \| \| scaffold14851_4685027_SNP | 4685027 | A | G |
| S_9504461 \| \| scaffold14851_4686038_SNP | 4686038 | G | A |
| S_9504516 \| \| scaffold14851_4686801_SNP | 4686801 | C | G |
| S_9504539 \| \| scaffold14851_4687229_SNP | 4687229 | A | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9504693 \| \| scaffold14851_4688922_SNP | 4688922 | A | T |
| S_9504950 \| \| scaffold14851_4692680_SNP | 4692680 | C | G |
| S_9504959 \| \| scaffold14851_4692776_SNP | 4692776 | C | T |
| S_9505006 \| \| scaffold14851_4693331_SNP | 4693331 | T | G |
| S_9505029 \| \| scaffold14851_4693713_SNP | 4693713 | C | G |
| S_9505031 \| \| scaffold14851_4693735_SNP | 4693735 | A | T |
| S_9505039 \| \| scaffold14851_4693840_SNP | 4693840 | A | G |
| S_9505041 \| \| scaffold14851_4693842_SNP | 4693842 | G | T |
| S_9505042 \| \| scaffold14851_4693859_SNP | 4693859 | T | C |
| S_9505055 \| \| scaffold14851_4694116_SNP | 4694116 | C | T |
| S_9505057 \| \| scaffold14851_4694128_SNP | 4694128 | G | C |
| S_9505105 \| \| scaffold14851_4694524_SNP | 4694524 | C | T |
| S_9505174 \| \| scaffold14851_4695359_SNP | 4695359 | C | A |
| S_9505322 \| \| scaffold14851_4697788_SNP | 4697788 | A | C |
| S_9505353 \| \| scaffold14851_4698233_SNP | 4698233 | G | A |
| S_9505356 \| \| scaffold14851_4698252_SNP | 4698252 | G | T |
| S_9505372 \| \| scaffold14851_4698451_SNP | 4698451 | G | C |
| S_9505382 \| \| scaffold14851_4698608_SNP | 4698608 | A | C |
| S_9505386 \| \| scaffold14851_4698653_SNP | 4698653 | G | T |
| S_9505480 \| \| scaffold14851_4700040_SNP | 4700040 | C | A |
| S_9505481 \| \| scaffold14851_4700050_SNP | 4700050 | G | C |
| S_9505482 \| \| scaffold14851_4700078_SNP | 4700078 | G | A |
| S_9505490 \| \| scaffold14851_4700255_SNP | 4700255 | A | T |
| S_9505491 \| \| scaffold14851_4700258_SNP | 4700258 | A | T |
| S_9505494 \| \| scaffold14851_4700304_SNP | 4700304 | G | A |
| S_9505514 \| \| scaffold14851_4700555_SNP | 4700555 | G | A |
| S_9505518 \| \| scaffold14851_4700618_SNP | 4700618 | A | G |
| S_9505519 \| \| scaffold14851_4700635_SNP | 4700635 | A | T |
| S_9505520 \| \| scaffold14851_4700638_SNP | 4700638 | A | C |
| S_9505521 \| \| scaffold14851_4700683_SNP | 4700683 | C | A |
| S_9505522 \| \| scaffold14851_4700712_SNP | 4700712 | C | G |
| S_9505543 \| \| scaffold14851_4701012_SNP | 4701012 | T | G |
| $_9505568 \| \| scaffold14851_4701401_SNP | 4701401 | A | T |
| S_9505614 \| \| scaffold14851_4701763_SNP | 4701763 | C | T |
| S_9505617 \| \| scaffold14851_4701845_SNP | 4701845 | A | T |
| S_9505621 \| \| scaffold14851_4701887_SNP | 4701887 | G | T |
| scaffold14851_4702227_SNP | 4702227 | A | C |
| scaffold14851_4702378_SNP | 4702378 | A | T |
| S_9505691 \| \| scaffold14851_4702410_SNP | 4702410 | C | A |
| S_9505692 \| \| scaffold14851_4702415_SNP | 4702415 | C | G |
| S_9505736 \| \| scaffold14851_4703235_SNP | 4703235 | G | C |
| S_9505740 \| \| scaffold14851_4703302_SNP | 4703302 | T | G |
| S_9505742 \| \| scaffold14851_4703312_SNP | 4703312 | G | T |
| S_9505761 \| \| scaffold14851_4703553_SNP | 4703553 | G | C |
| S_9505763 \| \| scaffold14851_4703588_SNP | 4703588 | A | G |
| scaffold14851_4703783_SNP | 4703783 | C | T |
| S_9505798 \| \| scaffold14851_4703791_SNP | 4703791 | T | C |
| S_9505802 \| \| scaffold14851_4703836_SNP | 4703836 | A | G |
| S_9505842 \| \| scaffold14851_4704102_SNP | 4704102 | A | T |
| S_9505868 \| \| scaffold14851_4704303_SNP | 4704303 | C | T |
| S_9505891 \| \| scaffold14851_4704572_SNP | 4704572 | C | G |
| S_9505895 \| \| scaffold14851_4704624_SNP | 4704624 | C | A |
| S_9505896 \| \| scaffold14851_4704626_SNP | 4704626 | A | G |
| S_9505901 \| \| scaffold14851_4704731_SNP | 4704731 | G | T |
| S_9505904 \| \| scaffold14851_4704779_SNP | 4704779 | A | T |
| S_9505910 \| \| scaffold14851_4704884_SNP | 4704884 | C | T |
| S_9505940 \| \| scaffold14851_4705298_SNP | 4705298 | G | A |
| S_9505963 \| \| scaffold14851_4705623_SNP | 4705623 | G | A |
| S_9506146 \| \| scaffold14851_4707754_SNP | 4707754 | T | C |
| S_9506171 \| \| scaffold14851_4707967_SNP | 4707967 | T | A |
| S_9506212 \| \| scaffold14851_4708551_SNP | 4708551 | T | C |
| S_9506213 \| \| scaffold14851_4708567_SNP | 4708567 | C | A |
| S_9506249 \| \| scaffold14851_4709139_SNP | 4709139 | G | T |
| S_9506266 \| \| scaffold14851_4709381_SNP | 4709381 | G | C |
| S_9506307 \| \| scaffold14851_4709966_SNP | 4709966 | C | T |
| S_9506338 \| \| scaffold14851_4710478_SNP | 4710478 | A | T |
| S_9506341 \| \| scaffold14851_4710500_SNP | 4710500 | G | A |
| S_9506351 \| \| scaffold14851_4710719_SNP | 4710719 | C | G |
| S_9506353 \| \| scaffold14851_4710775_SNP | 4710775 | A | G |
| S_9506360 \| \| scaffold14851_4710924_SNP | 4710924 | T | C |
| S_9506366 \| \| scaffold14851_4711029_SNP | 4711029 | T | G |
| S_9506369 \| \| scaffold14851_4711056_SNP | 4711056 | G | A |
| S_9506370 \| \| scaffold14851_4711063_SNP | 4711063 | A | G |
| S_9506437 \| \| scaffold14851_4712026_SNP | 4712026 | T | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9506451 \| \| scaffold14851_4712278_SNP | 4712278 | A | G |
| S_9506460 \| \| scaffold14851_4712357_SNP | 4712357 | G | A |
| S_9506462 \| \| scaffold14851_4712375_SNP | 4712375 | G | C |
| S_9506466 \| \| scaffold14851_4712429_SNP | 4712429 | A | G |
| S_9506486 \| \| scaffold14851_4712711_SNP | 4712711 | G | A |
| S_9506679 \| \| scaffold14851_4715033_SNP | 4715033 | T | G |
| S_9506707 \| \| scaffold14851_4715319_SNP | 4715319 | C | G |
| S_9506735 \| \| scaffold14851_4715620_SNP | 4715620 | A | G |
| S_9506739 \| \| scaffold14851_4715666_SNP | 4715666 | A | T |
| S_9506744 \| \| scaffold14851_4715774_SNP | 4715774 | A | T |
| S_9506809 \| \| scaffold14851_4716671_SNP | 4716671 | G | A |
| S_9506874 \| \| scaffold14851_4717633_SNP | 4717633 | G | A |
| S_9507079 \| \| scaffold14851_4720732_SNP | 4720732 | G | A |
| S_9507163 \| \| scaffold14851_4721245_SNP | 4721245 | T | C |
| S_9507222 \| \| scaffold14851_4721981_SNP | 4721981 | G | A |
| S_9507438 \| \| scaffold14851_4724588_SNP | 4724588 | C | G |
| S_9507444 \| \| scaffold14851_4724642_SNP | 4724642 | G | A |
| S_9507458 \| \| scaffold14851_4724775_SNP | 4724775 | G | T |
| S_9507574 \| \| scaffold14851_4726763_SNP | 4726763 | C | T |
| S_9507673 \| \| scaffold14851_4727866_SNP | 4727866 | G | T |
| S_9507680 \| \| scaffold14851_4727942_SNP | 4727942 | A | C |
| S_9507681 \| \| scaffold14851_4727945_SNP | 4727945 | C | T |
| S_9507744 \| \| scaffold14851_4728176_SNP | 4728176 | T | C |
| S_9507952 \| \| scaffold14851_4730017_SNP | 4730017 | T | C |
| S_9507953 \| \| scaffold14851_4730059_SNP | 4730059 | C | T |
| S_9507963 \| \| scaffold14851_4730246_SNP | 4730246 | A | G |
| S_9507967 \| \| scaffold14851_4730323_SNP | 4730323 | A | G |
| S_9507996 \| \| scaffold14851_4730838_SNP | 4730838 | C | A |
| S_9508022 \| \| scaffold14851_4731102_SNP | 4731102 | C | T |
| S_9508035 \| \| scaffold14851_4731248_SNP | 4731248 | C | T |
| S_9508143 \| \| scaffold14851_4732950_SNP | 4732950 | T | C |
| S_9508147 \| \| scaffold14851_4732980_SNP | 4732980 | A | G |
| S_9508239 \| \| scaffold14851_4734593_SNP | 4734593 | C | G |
| S_9508441 \| \| scaffold14851_4736190_SNP | 4736190 | T | A |
| S_9508724 \| \| scaffold14851_4739398_SNP | 4739398 | G | A |
| S_9508736 \| \| scaffold14851_4739629_SNP | 4739629 | C | G |
| S_9508765 \| \| scaffold14851_4740131_SNP | 4740131 | G | A |
| S_9508767 \| \| scaffold14851_4740164_SNP | 4740164 | C | A |
| S_9508811 \| \| scaffold14851_4740862_SNP | 4740862 | T | C |
| S_9508827 \| \| scaffold14851_4741093_SNP | 4741093 | C | A |
| scaffold14851_4742600_SNP | 4742600 | G | A |
| S_9509178 \| \| scaffold14851_4745135_SNP | 4745135 | G | A |
| S_9509251 \| \| scaffold14851_4746224_SNP | 4746224 | A | C |
| S_9509252 \| \| scaffold14851_4746234_SNP | 4746234 | T | G |
| S_9509260 \| \| scaffold14851_4746416_SNP | 4746416 | T | C |
| S_9509265 \| \| scaffold14851_4746459_SNP | 4746459 | A | G |
| S_9509342 \| \| scaffold14851_4747380_SNP | 4747380 | A | C |
| S_9509411 \| \| scaffold14851_4747929_SNP | 4747929 | G | T |
| S_9509555 \| \| scaffold14851_4749523_SNP | 4749523 | C | T |
| S_9509593 \| \| scaffold14851_4750174_SNP | 4750174 | G | A |
| S_9509597 \| \| scaffold14851_4750219_SNP | 4750219 | T | G |
| S_9509640 \| \| scaffold14851_4750706_SNP | 4750706 | T | G |
| S_9509644 \| \| scaffold14851_4750742_SNP | 4750742 | C | G |
| S_9509671 \| \| scaffold14851_4751078_SNP | 4751078 | A | G |
| S_9509677 \| \| scaffold14851_4751098_SNP | 4751098 | T | G |
| S_9509679 \| \| scaffold14851_4751158_SNP | 4751158 | A | G |
| S_9509829 \| \| scaffold14851_4752404_SNP | 4752404 | T | C |
| S_9509832 \| \| scaffold14851_4752476_SNP | 4752476 | A | G |
| S_9509833 \| \| scaffold14851_4752485_SNP | 4752485 | C | A |
| S_9509844 \| \| scaffold14851_4752707_SNP | 4752707 | T | A |
| S_9509877 \| \| scaffold14851_4753273_SNP | 4753273 | T | C |
| S_9509892 \| \| scaffold14851_4753484_SNP | 4753484 | G | A |
| S_9509900 \| \| scaffold14851_4753538_SNP | 4753538 | T | C |
| S_9509929 \| \| scaffold14851_4753952_SNP | 4753952 | T | C |
| S_9509938 \| \| scaffold14851_4754144_SNP | 4754144 | A | T |
| S_9509939 \| \| scaffold14851_4754155_SNP | 4754155 | G | A |
| S_9509941 \| \| scaffold14851_4754174_SNP | 4754174 | A | G |
| S_9509955 \| \| scaffold14851_4754316_SNP | 4754316 | A | G |
| S_9510029 \| \| scaffold14851_4755073_SNP | 4755073 | T | A |
| S_9510042 \| \| scaffold14851_4755356_SNP | 4755356 | T | G |
| S_9510043 \| \| scaffold14851_4755358_SNP | 4755358 | A | G |
| S_9510044 \| \| scaffold14851_4755362_SNP | 4755362 | C | A |
| S_9510178 \| \| scaffold14851_4757154_SNP | 4757154 | T | A |
| S_9510204 \| \| scaffold14851_4757864_SNP | 4757864 | G | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9510209 \| \| scaffold14851_4757984_SNP | 4757984 | T | A |
| S_9510210 \| \| scaffold14851_4757989_SNP | 4757989 | A | G |
| S_9510225 \| \| scaffold14851_4758112_SNP | 4758112 | A | T |
| S_9510244 \| \| scaffold14851_4758475_SNP | 4758475 | T | A |
| S_9510308 \| \| scaffold14851_4759660_SNP | 4759660 | T | C |
| S_9510619 \| \| scaffold14851_4762895_SNP | 4762895 | A | T |
| S_9510620 \| \| scaffold14851_4762897_SNP | 4762897 | A | T |
| S_9510879 \| \| scaffold14851_4765681_SNP | 4765681 | G | C |
| S_9510894 \| \| scaffold14851_4765956_SNP | 4765956 | C | A |
| S_9511365 \| \| scaffold14851_4768744_SNP | 4768744 | A | G |
| S_9511452 \| \| scaffold14851_4769774_SNP | 4769774 | T | A |
| S_9511492 \| \| scaffold14851_4770070_SNP | 4770070 | T | A |
| S_9511493 \| \| scaffold14851_4770071_SNP | 4770071 | T | A |
| S_9511494 \| \| scaffold14851_4770072_SNP | 4770072 | T | A |
| S_9511495 \| \| scaffold14851_4770073_SNP | 4770073 | T | A |
| S_9511511 \| \| scaffold14851_4770478_SNP | 4770478 | A | T |
| S_9511512 \| \| scaffold14851_4770505_SNP | 4770505 | G | A |
| S_9511518 \| \| scaffold14851_4770693_SNP | 4770693 | C | T |
| S_9511529 \| \| scaffold14851_4770804_SNP | 4770804 | G | A |
| S_9511570 \| \| scaffold14851_4771379_SNP | 4771379 | T | C |
| S_9511584 \| \| scaffold14851_4771807_SNP | 4771807 | A | G |
| S_9511585 \| \| scaffold14851_4771833_SNP | 4771833 | C | T |
| S_9511586 \| \| scaffold14851_4771888_SNP | 4771888 | T | C |
| S_9511587 \| \| scaffold14851_4771899_SNP | 4771899 | A | G |
| S_9511588 \| \| scaffold14851_4771930_SNP | 4771930 | A | G |
| S_9511590 \| \| scaffold14851_4772009_SNP | 4772009 | T | C |
| S_9511591 \| \| scaffold14851_4772010_SNP | 4772010 | A | C |
| S_9511592 \| \| scaffold14851_4772040_SNP | 4772040 | G | A |
| S_9511594 \| \| scaffold14851_4772072_SNP | 4772072 | T | C |
| S_9511595 \| \| scaffold14851_4772076_SNP | 4772076 | G | A |
| S_9511605 \| \| scaffold14851_4772351_SNP | 4772351 | A | G |
| S_9511747 \| \| scaffold14851_4774353_SNP | 4774353 | C | G |
| S_9511748 \| \| scaffold14851_4774356_SNP | 4774356 | A | T |
| S_9511761 \| \| scaffold14851_4774529_SNP | 4774529 | T | G |
| S_9511762 \| \| scaffold14851_4774537_SNP | 4774537 | T | C |
| S_9511778 \| \| scaffold14851_4774763_SNP | 4774763 | T | A |
| S_9511794 \| \| scaffold14851_4775086_SNP | 4775086 | C | G |
| S_9511800 \| \| scaffold14851_4775244_SNP | 4775244 | T | A |
| S_9511811 \| \| scaffold14851_4775373_SNP | 4775373 | G | T |
| S_9511815 \| \| scaffold14851_4775401_SNP | 4775401 | C | T |
| S_9511816 \| \| scaffold14851_4775423_SNP | 4775423 | C | T |
| S_9511818 \| \| scaffold14851_4775440_SNP | 4775440 | T | G |
| S_9511822 \| \| scaffold14851_4775557_SNP | 4775557 | C | T |
| S_9511823 \| \| scaffold14851_4775609_SNP | 4775609 | T | C |
| S_9511824 \| \| scaffold14851_4775624_SNP | 4775624 | A | G |
| S_9511825 \| \| scaffold14851_4775640_SNP | 4775640 | T | A |
| S_9511896 \| \| scaffold14851_4775888_SNP | 4775888 | T | A |
| S_9511905 \| \| scaffold14851_4776001_SNP | 4776001 | G | C |
| S_9511961 \| \| scaffold14851_4776444_SNP | 4776444 | C | A |
| S_9512063 \| \| scaffold14851_4777406_SNP | 4777406 | G | A |
| S_9512123 \| \| scaffold14851_4778145_SNP | 4778145 | G | A |
| S_9512127 \| \| scaffold14851_4778178_SNP | 4778178 | T | G |
| S_9512225 \| \| scaffold14851_4779649_SNP | 4779649 | C | T |
| S_9512227 \| \| scaffold14851_4779660_SNP | 4779660 | C | T |
| S_9512228 \| \| scaffold14851_4779696_SNP | 4779696 | T | A |
| S_9512229 \| \| scaffold14851_4779801_SNP | 4779801 | C | T |
| S_9512245 \| \| scaffold14851_4779997_SNP | 4779997 | T | G |
| scaffold14851_4783411_SNP | 4783411 | T | A |
| scaffold14851_4783412_SNP | 4783412 | T | A |
| scaffold14851_4783413_SNP | 4783413 | T | A |
| S_9512538 \| \| scaffold14851_4783415_SNP | 4783415 | T | A |
| S_9512642 \| \| scaffold14851_4784629_SNP | 4784629 | G | C |
| S_9512643 \| \| scaffold14851_4784651_SNP | 4784651 | A | G |
| S_9512646 \| \| scaffold14851_4784688_SNP | 4784688 | T | A |
| S_9512665 \| \| scaffold14851_4784876_SNP | 4784876 | A | T |
| S_9512704 \| \| scaffold14851_4785502_SNP | 4785502 | C | T |
| S_9512705 \| \| scaffold14851_4785505_SNP | 4785505 | C | T |
| S_9512740 \| \| scaffold14851_4786480_SNP | 4786480 | G | A |
| S_9512817 \| \| scaffold14851_4787719_SNP | 4787719 | A | G |
| S_9512958 \| \| scaffold14851_4789730_SNP | 4789730 | G | C |
| S_9513004 \| \| scaffold14851_4790443_SNP | 4790443 | A | C |
| S_9513005 \| \| scaffold14851_4790456_SNP | 4790456 | A | G |
| S_9513006 \| \| scaffold14851_4790467_SNP | 4790467 | G | A |
| S_9513021 \| \| scaffold14851_4790694_SNP | 4790694 | C | G |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9513023 \| \| scaffold14851_4790704_SNP | 4790704 | C | G |
| S_9513027 \| \| scaffold14851_4790745_SNP | 4790745 | A | T |
| S_9513042 \| \| scaffold14851_4790966_SNP | 4790966 | T | C |
| S_9513054 \| \| scaffold14851_4791108_SNP | 4791108 | A | T |
| S_9513065 \| \| scaffold14851_4791278_SNP | 4791278 | A | C |
| S_9513078 \| \| scaffold14851_4791636_SNP | 4791636 | T | A |
| S_9513085 \| \| scaffold14851_4791686_SNP | 4791686 | A | C |
| S_9513172 \| \| scaffold14851_4793061_SNP | 4793061 | T | G |
| S_9513200 \| \| scaffold14851_4793296_SNP | 4793296 | A | G |
| S_9513356 \| \| scaffold14851_4794651_SNP | 4794651 | G | A |
| S_9513375 \| \| scaffold14851_4795024_SNP | 4795024 | T | C |
| S_9513376 \| \| scaffold14851_4795027_SNP | 4795027 | G | A |
| S_9513436 \| \| scaffold14851_4795336_SNP | 4795336 | G | T |
| S_9513480 \| \| scaffold14851_4795922_SNP | 4795922 | C | G |
| S_9513493 \| \| scaffold14851_4796346_SNP | 4796346 | C | A |
| S_9513533 \| \| scaffold14851_4796902_SNP | 4796902 | G | T |
| S_9513557 \| \| scaffold14851_4797292_SNP | 4797292 | A | C |
| S_9513563 \| \| scaffold14851_4797356_SNP | 4797356 | G | A |
| S_9513564 \| \| scaffold14851_4797363_SNP | 4797363 | T | G |
| S_9513570 \| \| scaffold14851_4797511_SNP | 4797511 | G | A |
| S_9513637 \| \| scaffold14851_4798445_SNP | 4798445 | G | T |
| S_9513640 \| \| scaffold14851_4798460_SNP | 4798460 | A | T |
| S_9513698 \| \| scaffold14851_4799386_SNP | 4799386 | G | C |
| S_9513714 \| \| scaffold14851_4799667_SNP | 4799667 | G | A |
| S_9513715 \| \| scaffold14851_4799676_SNP | 4799676 | T | C |
| S_9513717 \| \| scaffold14851_4799696_SNP | 4799696 | T | A |
| S_9513723 \| \| scaffold14851_4799745_SNP | 4799745 | T | C |
| S_9514041 \| \| scaffold14851_4804078_SNP | 4804078 | A | T |
| S_9514046 \| \| scaffold14851_4804129_SNP | 4804129 | T | A |
| S_9514047 \| \| scaffold14851_4804132_SNP | 4804132 | A | C |
| S_9514089 \| \| scaffold14851_4804908_SNP | 4804908 | C | T |
| S_9514092 \| \| scaffold14851_4804954_SNP | 4804954 | C | A |
| S_9514263 \| \| scaffold14851_4807348_SNP | 4807348 | T | G |
| S_9514338 \| \| scaffold14851_4808505_SNP | 4808505 | C | T |
| S_9514359 \| \| scaffold14851_4808689_SNP | 4808689 | C | G |
| S_9514379 \| \| scaffold14851_4809016_SNP | 4809016 | A | T |
| S_9514449 \| \| scaffold14851_4810083_SNP | 4810083 | A | T |
| S_9514519 \| \| scaffold14851_4810555_SNP | 4810555 | C | A |
| S_9514573 \| \| scaffold14851_4811398_SNP | 4811398 | T | A |
| S_9514579 \| \| scaffold14851_4811492_SNP | 4811492 | T | G |
| S_9514610 \| \| scaffold14851_4812011_SNP | 4812011 | A | C |
| S_9514657 \| \| scaffold14851_4812208_SNP | 4812208 | G | T |
| S_9514658 \| \| scaffold14851_4812216_SNP | 4812216 | A | G |
| S_9514685 \| \| scaffold14851_4812526_SNP | 4812526 | T | A |
| S_9514688 \| \| scaffold14851_4812591_SNP | 4812591 | C | T |
| S_9514689 \| \| scaffold14851_4812637_SNP | 4812637 | T | G |
| S_9514716 \| \| scaffold14851_4813108_SNP | 4813108 | T | A |
| S_9514746 \| \| scaffold14851_4813563_SNP | 4813563 | A | C |
| S_9514808 \| \| scaffold14851_4813669_SNP | 4813669 | T | C |
| S_9514831 \| \| scaffold14851_4813723_SNP | 4813723 | C | T |
| S_9514835 \| \| scaffold14851_4813806_SNP | 4813806 | A | G |
| S_9514843 \| \| scaffold14851_4813964_SNP | 4813964 | T | G |
| S_9514853 \| \| scaffold14851_4814260_SNP | 4814260 | C | G |
| S_9514857 \| \| scaffold14851_4814292_SNP | 4814292 | G | T |
| S_9514901 \| \| scaffold14851_4814637_SNP | 4814637 | G | T |
| S_9514977 \| \| scaffold14851_4816351_SNP | 4816351 | A | C |
| S_9515108 \| \| scaffold14851_4818327_SNP | 4818327 | G | C |
| S_9515152 \| \| scaffold14851_4819084_SNP | 4819084 | A | T |
| S_9515157 \| \| scaffold14851_4819139_SNP | 4819139 | A | G |
| S_9515160 \| \| scaffold14851_4819189_SNP | 4819189 | C | G |
| S_9515198 \| \| scaffold14851_4820314_SNP | 4820314 | T | C |
| S_9515289 \| \| scaffold14851_4821486_SNP | 4821486 | T | C |
| S_9515626 \| \| scaffold14851_4824784_SNP | 4824784 | T | C |
| S_9515767 \| \| scaffold14851_4827081_SNP | 4827081 | A | C |
| S_9515792 \| \| scaffold14851_4827457_SNP | 4827457 | A | T |
| S_9516000 \| \| scaffold14851_4829823_SNP | 4829823 | A | G |
| S_9516012 \| \| scaffold14851_4830132_SNP | 4830132 | G | A |
| S_9516013 \| \| scaffold14851_4830166_SNP | 4830166 | C | T |
| S_9516015 \| \| scaffold14851_4830175_SNP | 4830175 | A | T |
| S_9516016 \| \| scaffold14851_4830179_SNP | 4830179 | A | T |
| S_9516020 \| \| scaffold14851_4830213_SNP | 4830213 | C | G |
| S_9516021 \| \| scaffold14851_4830233_SNP | 4830233 | A | G |
| S_9516076 \| \| scaffold14851_4830973_SNP | 4830973 | G | A |
| S_9516138 \| \| scaffold14851_4832252_SNP | 4832252 | C | A |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9516146 \| \| scaffold14851_4832486_SNP | 4832486 | A | T |
| S_9516154 \| \| scaffold14851_4832699_SNP | 4832699 | G | A |
| S_9516253 \| \| scaffold14851_4833926_SNP | 4833926 | A | T |
| S_9516355 \| \| scaffold14851_4835328_SNP | 4835328 | A | G |
| S_9516363 \| \| scaffold14851_4835539_SNP | 4835539 | C | G |
| S_9516412 \| \| scaffold14851_4836527_SNP | 4836527 | C | G |
| S_9516592 \| \| scaffold14851_4839191_SNP | 4839191 | T | A |
| S_9516627 \| \| scaffold14851_4839797_SNP | 4839797 | G | A |
| S_9516691 \| \| scaffold14851_4840590_SNP | 4840590 | A | G |
| S_9516725 \| \| scaffold14851_4841251_SNP | 4841251 | A | G |
| S_9516728 \| \| scaffold14851_4841276_SNP | 4841276 | A | G |
| S_9516731 \| \| scaffold14851_4841341_SNP | 4841341 | C | T |
| S_9516846 \| \| scaffold14851_4842604_SNP | 4842604 | T | C |
| S_9516968 \| \| scaffold14851_4843908_SNP | 4843908 | T | C |
| S_9517108 \| \| scaffold14851_4845999_SNP | 4845999 | C | G |
| S_9517162 \| \| scaffold14851_4846770_SNP | 4846770 | T | A |
| S_9517170 \| \| scaffold14851_4846911_SNP | 4846911 | T | C |
| S_9517250 \| \| scaffold14851_4847987_SNP | 4847987 | G | A |
| S_9517270 \| \| scaffold14851_4848218_SNP | 4848218 | A | C |
| S_9517314 \| \| scaffold14851_4848861_SNP | 4848861 | A | T |
| S_9517382 \| \| scaffold14851_4849642_SNP | 4849642 | T | C |
| S_9517416 \| \| scaffold14851_4849907_SNP | 4849907 | C | G |
| S_9517433 \| \| scaffold14851_4850068_SNP | 4850068 | T | C |
| S_9517434 \| \| scaffold14851_4850092_SNP | 4850092 | A | G |
| S_9517453 \| \| scaffold14851_4850540_SNP | 4850540 | C | T |
| S_9517494 \| \| scaffold14851_4851296_SNP | 4851296 | A | G |
| S_9517495 \| \| scaffold14851_4851299_SNP | 4851299 | T | A |
| S_9517523 \| \| scaffold14851_4851864_SNP | 4851864 | T | A |
| S_9517558 \| \| scaffold14851_4852533_SNP | 4852533 | T | A |
| S_9517560 \| \| scaffold14851_4852572_SNP | 4852572 | C | T |
| S_9517565 \| \| scaffold14851_4852659_SNP | 4852659 | A | C |
| S_9517574 \| \| scaffold14851_4852884_SNP | 4852884 | C | T |
| S_9517599 \| \| scaffold14851_4853364_SNP | 4853364 | T | C |
| S_9517760 \| \| scaffold14851_4855197_SNP | 4855197 | G | T |
| S_9517766 \| \| scaffold14851_4855354_SNP | 4855354 | C | A |
| S_9517802 \| \| scaffold14851_4855855_SNP | 4855855 | A | G |
| S_9517805 \| \| scaffold14851_4855918_SNP | 4855918 | T | C |
| S_9517844 \| \| scaffold14851_4856421_SNP | 4856421 | G | A |
| S_9518042 \| \| scaffold14851_4858944_SNP | 4858944 | C | A |
| scaffold14851_4863712_SNP | 4863712 | G | A |
| S_9518602 \| \| scaffold14851_4866480_SNP | 4866480 | A | G |
| S_9518848 \| \| scaffold14851_4868054_SNP | 4868054 | A | C |
| S_9518991 \| \| scaffold14851_4870098_SNP | 4870098 | T | C |
| S_9518998 \| \| scaffold14851_4870214_SNP | 4870214 | A | C |
| S_9519097 \| \| scaffold14851_4871095_SNP | 4871095 | G | A |
| S_9519118 \| \| scaffold14851_4871519_SNP | 4871519 | C | T |
| S_9519154 \| \| scaffold14851_4872041_SNP | 4872041 | A | G |
| S_9519155 \| \| scaffold14851_4872051_SNP | 4872051 | T | G |
| S_9519165 \| \| scaffold14851_4872287_SNP | 4872287 | G | A |
| S_9519166 \| \| scaffold14851_4872297_SNP | 4872297 | T | C |
| S_9519167 \| \| scaffold14851_4872301_SNP | 4872301 | A | G |
| S_9519343 \| \| scaffold14851_4874803_SNP | 4874803 | G | A |
| S_9519392 \| \| scaffold14851_4875468_SNP | 4875468 | A | G |
| S_9519403 \| \| scaffold14851_4875591_SNP | 4875591 | G | C |
| S_9519419 \| \| scaffold14851_4875833_SNP | 4875833 | A | C |
| S_9519420 \| \| scaffold14851_4875835_SNP | 4875835 | G | T |
| S_9519791 \| \| scaffold14851_4880574_SNP | 4880574 | A | G |
| S_9519827 \| \| scaffold14851_4881075_SNP | 4881075 | T | C |
| S_9519973 \| \| scaffold14851_4882672_SNP | 4882672 | A | T |
| S_9519979 \| \| scaffold14851_4882833_SNP | 4882833 | T | C |
| S_9520001 \| \| scaffold14851_4883115_SNP | 4883115 | G | A |
| S_9520006 \| \| scaffold14851_4883189_SNP | 4883189 | G | A |
| S_9520008 \| \| scaffold14851_4883198_SNP | 4883198 | C | T |
| S_9520009 \| \| scaffold14851_4883199_SNP | 4883199 | A | T |
| S_9520242 \| \| scaffold14851_4886665_SNP | 4886665 | C | G |
| S_9520255 \| \| scaffold14851_4886804_SNP | 4886804 | T | A |
| S_9520303 \| \| scaffold14851_4887433_SNP | 4887433 | C | G |
| S_9520313 \| \| scaffold14851_4887551_SNP | 4887551 | T | C |
| S_9520314 \| \| scaffold14851_4887554_SNP | 4887554 | C | T |
| S_9520317 \| \| scaffold14851_4887600_SNP | 4887600 | T | C |
| S_9520322 \| \| scaffold14851_4887676_SNP | 4887676 | C | A |
| S_9520418 \| \| scaffold14851_4888666_SNP | 4888666 | A | G |
| S_9520487 \| \| scaffold14851_4889160_SNP | 4889160 | T | C |
| S_9520488 \| \| scaffold14851_4889176_SNP | 4889176 | T | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9520489 \|\| scaffold14851_4889177_SNP | 4889177 | A | G |
| S_9520490 \|\| scaffold14851_4889192_SNP | 4889192 | C | T |
| S_9520492 \|\| scaffold14851_4889209_SNP | 4889209 | T | C |
| S_9520507 \|\| scaffold14851_4889482_SNP | 4889482 | T | C |
| S_9520508 \|\| scaffold14851_4889483_SNP | 4889483 | C | T |
| S_9520511 \|\| scaffold14851_4889512_SNP | 4889512 | G | A |
| S_9520514 \|\| scaffold14851_4889541_SNP | 4889541 | T | C |
| S_9520737 \|\| scaffold14851_4892744_SNP | 4892744 | G | A |
| scaffold14851_4892782_SNP | 4892782 | A | G |
| scaffold14851_4892796_SNP | 4892796 | T | C |
| scaffold14851_4892803_SNP | 4892803 | C | T |
| S_9520756 \|\| scaffold14851_4892906_SNP | 4892906 | T | G |
| S_9520911 \|\| scaffold14851_4894896_SNP | 4894896 | G | A |
| S_9520912 \|\| scaffold14851_4894898_SNP | 4894898 | G | A |
| $_9520970 \|\| scaffold14851_4895394_SNP | 4895394 | C | G |
| S_9521068 \|\| scaffold14851_4896001_SNP | 4896001 | C | T |
| S_9521160 \|\| scaffold14851_4897319_SNP | 4897319 | G | C |
| S_9521166 \|\| scaffold14851_4897356_SNP | 4897356 | G | C |
| S_9521259 \|\| scaffold14851_4898615_SNP | 4898615 | G | A |
| S_9521298 \|\| scaffold14851_4899266_SNP | 4899266 | C | A |
| S_9521310 \|\| scaffold14851_4899345_SNP | 4899345 | C | T |
| S_9521341 \|\| scaffold14851_4899694_SNP | 4899694 | T | A |
| S_9521396 \|\| scaffold14851_4900598_SNP | 4900598 | C | G |
| S_9521483 \|\| scaffold14851_4901932_SNP | 4901932 | A | T |
| S_9521507 \|\| scaffold14851_4902114_SNP | 4902114 | A | T |
| S_9521518 \|\| scaffold14851_4902264_SNP | 4902264 | G | C |
| S_9521561 \|\| scaffold14851_4902827_SNP | 4902827 | A | C |
| S_9521562 \|\| scaffold14851_4902828_SNP | 4902828 | G | T |
| S_9521564 \|\| scaffold14851_4902853_SNP | 4902853 | C | G |
| S_9521629 \|\| scaffold14851_4903724_SNP | 4903724 | T | G |
| S_9521631 \|\| scaffold14851_4903729_SNP | 4903729 | G | A |
| S_9521690 \|\| scaffold14851_4904792_SNP | 4904792 | G | T |
| S_9521711 \|\| scaffold14851_4905191_SNP | 4905191 | T | A |
| S_9521713 \|\| scaffold14851_4905237_SNP | 4905237 | A | G |
| S_9521726 \|\| scaffold14851_4905516_SNP | 4905516 | G | A |
| S_9521775 \|\| scaffold14851_4906170_SNP | 4906170 | T | C |
| S_9521776 \|\| scaffold14851_4906172_SNP | 4906172 | C | T |
| S_9521799 \|\| scaffold14851_4906709_SNP | 4906709 | T | C |
| S_9521851 \|\| scaffold14851_4907335_SNP | 4907335 | A | T |
| S_9521894 \|\| scaffold14851_4907481_SNP | 4907481 | C | G |
| S_9521900 \|\| scaffold14851_4907555_SNP | 4907555 | T | C |
| S_9521906 \|\| scaffold14851_4907640_SNP | 4907640 | C | T |
| S_9522088 \|\| scaffold14851_4910641_SNP | 4910641 | A | T |
| S_9522204 \|\| scaffold14851_4913076_SNP | 4913076 | A | C |
| S_9522263 \|\| scaffold14851_4913997_SNP | 4913997 | C | T |
| S_9522297 \|\| scaffold14851_4914799_SNP | 4914799 | G | A |
| S_9522299 \|\| scaffold14851_4914817_SNP | 4914817 | A | G |
| S_9522447 \|\| scaffold14851_4916282_SNP | 4916282 | C | G |
| S_9522537 \|\| scaffold14851_4917152_SNP | 4917152 | T | C |
| S_9522538 \|\| scaffold14851_4917154_SNP | 4917154 | A | T |
| S_9522601 \|\| scaffold14851_4917946_SNP | 4917946 | C | T |
| S_9522610 \|\| scaffold14851_4918036_SNP | 4918036 | C | G |
| S_9522623 \|\| scaffold14851_4918227_SNP | 4918227 | G | A |
| S_9522814 \|\| scaffold14851_4921414_SNP | 4921414 | A | C |
| S_9523024 \|\| scaffold14851_4923475_SNP | 4923475 | T | A |
| S_9523033 \|\| scaffold14851_4923709_SNP | 4923709 | T | C |
| S_9523048 \|\| scaffold14851_4923942_SNP | 4923942 | T | A |
| S_9523059 \|\| scaffold14851_4924046_SNP | 4924046 | T | A |
| S_9523062 \|\| scaffold14851_4924155_SNP | 4924155 | C | T |
| S_9523064 \|\| scaffold14851_4924230_SNP | 4924230 | G | A |
| S_9523071 \|\| scaffold14851_4924417_SNP | 4924417 | T | C |
| S_9523073 \|\| scaffold14851_4924424_SNP | 4924424 | G | A |
| S_9523175 \|\| scaffold14851_4925737_SNP | 4925737 | A | T |
| S_9523190 \|\| scaffold14851_4926163_SNP | 4926163 | A | T |
| S_9523263 \|\| scaffold14851_4926927_SNP | 4926927 | T | G |
| S_9523274 \|\| scaffold14851_4927171_SNP | 4927171 | A | T |
| S_9523279 \|\| scaffold14851_4927262_SNP | 4927262 | C | T |
| S_9523291 \|\| scaffold14851_4927590_SNP | 4927590 | A | G |
| S_9523311 \|\| scaffold14851_4927703_SNP | 4927703 | C | T |
| S_9523417 \|\| scaffold14851_4929369_SNP | 4929369 | C | T |
| S_9523572 \|\| scaffold14851_4930786_SNP | 4930786 | A | T |
| S_9523574 \|\| scaffold14851_4930848_SNP | 4930848 | A | G |
| S_9523704 \|\| scaffold14851_4932395_SNP | 4932395 | C | A |
| S_9523761 \|\| scaffold14851_4933130_SNP | 4933130 | C | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9523881 \| \| scaffold14851_4934969_SNP | 4934969 | C | A |
| S_9523989 \| \| scaffold14851_4936533_SNP | 4936533 | A | G |
| S_9524024 \| \| scaffold14851_4936877_SNP | 4936877 | C | T |
| S_9524114 \| \| scaffold14851_4937941_SNP | 4937941 | G | C |
| S_9524279 \| \| scaffold14851_4940129_SNP | 4940129 | G | A |
| S_9524289 \| \| scaffold14851_4940244_SNP | 4940244 | G | C |
| S_9524545 \| \| scaffold14851_4942765_SNP | 4942765 | A | T |
| S_9524885 \| \| scaffold14851_4946974_SNP | 4946974 | T | C |
| S_9524886 \| \| scaffold14851_4946979_SNP | 4946979 | C | T |
| S_9524908 \| \| scaffold14851_4947352_SNP | 4947352 | G | A |
| S_9524918 \| \| scaffold14851_4947625_SNP | 4947625 | A | G |
| S_9524943 \| \| scaffold14851_4947957_SNP | 4947957 | C | G |
| S_9524950 \| \| scaffold14851_4948101_SNP | 4948101 | T | C |
| S_9524954 \| \| scaffold14851_4948225_SNP | 4948225 | A | T |
| S_9524968 \| \| scaffold14851_4948429_SNP | 4948429 | C | T |
| S_9524998 \| \| scaffold14851_4948691_SNP | 4948691 | G | A |
| S_9524999 \| \| scaffold14851_4948692_SNP | 4948692 | G | C |
| S_9525040 \| \| scaffold14851_4949051_SNP | 4949051 | G | A |
| S_9525151 \| \| scaffold14851_4950361_SNP | 4950361 | A | T |
| S_9525158 \| \| scaffold14851_4950504_SNP | 4950504 | T | C |
| S_9525160 \| \| scaffold14851_4950566_SNP | 4950566 | A | G |
| S_9525174 \| \| scaffold14851_4950760_SNP | 4950760 | T | C |
| S_9525179 \| \| scaffold14851_4950831_SNP | 4950831 | A | G |
| S_9525214 \| \| scaffold14851_4951241_SNP | 4951241 | C | T |
| S_9525232 \| \| scaffold14851_4951410_SNP | 4951410 | A | G |
| S_9525254 \| \| scaffold14851_4951861_SNP | 4951861 | A | C |
| S_9525382 \| \| scaffold14851_4954056_SNP | 4954056 | G | T |
| S_9525385 \| \| scaffold14851_4954111_SNP | 4954111 | C | G |
| S_9525386 \| \| scaffold14851_4954139_SNP | 4954139 | A | G |
| S_9525392 \| \| scaffold14851_4954179_SNP | 4954179 | T | C |
| S_9525395 \| \| scaffold14851_4954210_SNP | 4954210 | T | G |
| S_9525397 \| \| scaffold14851_4954218_SNP | 4954218 | A | G |
| S_9525399 \| \| scaffold14851_4954238_SNP | 4954238 | G | C |
| S_9525539 \| \| scaffold14851_4956626_SNP | 4956626 | A | T |
| S_9525621 \| \| scaffold14851_4957608_SNP | 4957608 | G | A |
| S_9525631 \| \| scaffold14851_4957776_SNP | 4957776 | T | A |
| S_9525650 \| \| scaffold14851_4957997_SNP | 4957997 | T | C |
| S_9525696 \| \| scaffold14851_4958712_SNP | 4958712 | T | A |
| S_9525697 \| \| scaffold14851_4958719_SNP | 4958719 | T | C |
| S_9525788 \| \| scaffold14851_4959878_SNP | 4959878 | A | G |
| S_9525885 \| \| scaffold14851_4961078_SNP | 4961078 | G | C |
| S_9525920 \| \| scaffold14851_4961724_SNP | 4961724 | G | A |
| S_9526019 \| \| scaffold14851_4965635_SNP | 4965635 | T | A |
| S_9526033 \| \| scaffold14851_4965823_SNP | 4965823 | A | G |
| S_9526107 \| \| scaffold14851_4967178_SNP | 4967178 | C | G |
| S_9526328 \| \| scaffold14851_4969020_SNP | 4969020 | T | A |
| S_9526389 \| \| scaffold14851_4969759_SNP | 4969759 | G | T |
| S_9526390 \| \| scaffold14851_4969769_SNP | 4969769 | C | T |
| S_9526442 \| \| scaffold14851_4970584_SNP | 4970584 | T | A |
| S_9526596 \| \| scaffold14851_4974375_SNP | 4974375 | T | A |
| S_9526598 \| \| scaffold14851_4974385_SNP | 4974385 | A | T |
| S_9526751 \| \| scaffold14851_4976486_SNP | 4976486 | A | T |
| S_9526795 \| \| scaffold14851_4977106_SNP | 4977106 | G | A |
| S_9526797 \| \| scaffold14851_4977131_SNP | 4977131 | T | C |
| S_9526801 \| \| scaffold14851_4977173_SNP | 4977173 | C | G |
| S_9526826 \| \| scaffold14851_4977375_SNP | 4977375 | A | T |
| S_9526830 \| \| scaffold14851_4977429_SNP | 4977429 | G | A |
| S_9526839 \| \| scaffold14851_4977547_SNP | 4977547 | T | C |
| S_9526889 \| \| scaffold14851_4978383_SNP | 4978383 | A | C |
| S_9526890 \| \| scaffold14851_4978386_SNP | 4978386 | T | G |
| S_9526951 \| \| scaffold14851_4979088_SNP | 4979088 | A | G |
| S_9526996 \| \| scaffold14851_4979825_SNP | 4979825 | T | C |
| S_9527020 \| \| scaffold14851_4979999_SNP | 4979999 | C | T |
| S_9527079 \| \| scaffold14851_4980269_SNP | 4980269 | A | T |
| S_9527131 \| \| scaffold14851_4980740_SNP | 4980740 | C | A |
| S_9527134 \| \| scaffold14851_4980857_SNP | 4980857 | C | T |
| S_9527145 \| \| scaffold14851_4981068_SNP | 4981068 | A | T |
| S_9527169 \| \| scaffold14851_4981352_SNP | 4981352 | C | T |
| S_9527474 \| \| scaffold14851_4984704_SNP | 4984704 | A | G |
| S_9527493 \| \| scaffold14851_4984820_SNP | 4984820 | T | A |
| S_9527646 \| \| scaffold14851_4987504_SNP | 4987504 | T | C |
| S_9527696 \| \| scaffold14851_4988046_SNP | 4988046 | A | G |
| S_9527887 \| \| scaffold14851_4990419_SNP | 4990419 | G | A |
| S_9527961 \| \| scaffold14851_4991690_SNP | 4991690 | T | C |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9528207 \| \| scaffold14851_4995023_SNP | 4995023 | A | G |
| S_9528236 \| \| scaffold14851_4995331_SNP | 4995331 | A | T |
| S_9528557 \| \| scaffold14851_5000071_SNP | 5000071 | C | A |
| S_9528565 \| \| scaffold14851_5000221_SNP | 5000221 | G | C |
| S_9528690 \| \| scaffold14851_5001590_SNP | 5001590 | T | A |
| S_9528704 \| \| scaffold14851_5001790_SNP | 5001790 | A | T |
| S_9528766 \| \| scaffold14851_5002264_SNP | 5002264 | T | A |
| S_9528831 \| \| scaffold14851_5002827_SNP | 5002827 | A | G |
| S_9528863 \| \| scaffold14851_5003215_SNP | 5003215 | C | A |
| S_9528936 \| \| scaffold14851_5003596_SNP | 5003596 | T | A |
| S_9528943 \| \| scaffold14851_5003624_SNP | 5003624 | C | T |
| S_9528944 \| \| scaffold14851_5003626_SNP | 5003626 | G | A |
| S_9529193 \| \| scaffold14851_5004304_SNP | 5004304 | A | G |
| scaffold14851_5004438_SNP | 5004438 | G | A |
| S_9529231 \| \| scaffold14851_5004487_SNP | 5004487 | C | T |
| S_9529271 \| \| scaffold14851_5004951_SNP | 5004951 | A | G |
| S_9529310 \| \| scaffold14851_5005409_SNP | 5005409 | G | A |
| S_9529385 \| \| scaffold14851_5006453_SNP | 5006453 | C | T |
| scaffold14851_5008356_SNP | 5008356 | G | T |
| S_9529834 \| \| scaffold14851_5009933_SNP | 5009933 | G | A |
| S_9529904 \| \| scaffold14851_5011338_SNP | 5011338 | A | C |
| S_9529940 \| \| scaffold14851_5011836_SNP | 5011836 | A | G |
| S_9530168 \| \| scaffold14851_5013529_SNP | 5013529 | T | G |
| S_9530199 \| \| scaffold14851_5013962_SNP | 5013962 | A | G |
| S_9530217 \| \| scaffold14851_5014122_SNP | 5014122 | T | C |
| S_9530251 \| \| scaffold14851_5014539_SNP | 5014539 | G | A |
| S_9530263 \| \| scaffold14851_5014625_SNP | 5014625 | C | T |
| S_9530512 \| \| scaffold14851_5022950_SNP | 5022950 | T | G |
| S_9530537 \| \| scaffold14851_5023114_SNP | 5023114 | C | T |
| S_9530542 \| \| scaffold14851_5023239_SNP | 5023239 | A | G |
| S_9530596 \| \| scaffold14851_5023498_SNP | 5023498 | C | T |
| S_9530600 \| \| scaffold14851_5023525_SNP | 5023525 | T | A |
| S_9530770 \| \| scaffold14851_5026066_SNP | 5026066 | T | G |
| S_9530801 \| \| scaffold14851_5026478_SNP | 5026478 | G | C |
| S_9530961 \| \| scaffold14851_5028130_SNP | 5028130 | G | A |
| S_9531062 \| \| scaffold14851_5029530_SNP | 5029530 | T | C |
| S_9531114 \| \| scaffold14851_5030097_SNP | 5030097 | A | T |
| S_9531381 \| \| scaffold14851_5034009_SNP | 5034009 | T | C |
| S_9531449 \| \| scaffold14851_5034422_SNP | 5034422 | T | C |
| S_9531587 \| \| scaffold14851_5035090_SNP | 5035090 | G | T |
| S_9531787 \| \| scaffold14851_5036372_SNP | 5036372 | C | T |
| S_9532133 \| \| scaffold14851_5038521_SNP | 5038521 | A | G |
| S_9532195 \| \| scaffold14851_5038679_SNP | 5038679 | A | T |
| scaffold14851_5038727_SNP | 5038727 | A | G |
| S_9532687 \| \| scaffold14851_5041344_SNP | 5041344 | A | G |
| S_9532858 \| \| scaffold14851_5044024_SNP | 5044024 | G | A |
| S_9532871 \| \| scaffold14851_5044337_SNP | 5044337 | A | G |
| S_9532877 \| \| scaffold14851_5044520_SNP | 5044520 | T | C |
| S_9532882 \| \| scaffold14851_5044630_SNP | 5044630 | G | A |
| S_9533477 \| \| scaffold14851_5050528_SNP | 5050528 | A | T |
| S_9533484 \| \| scaffold14851_5050735_SNP | 5050735 | C | T |
| S_9533507 \| \| scaffold14851_5051061_SNP | 5051061 | A | G |
| S_9533581 \| \| scaffold14851_5052115_SNP | 5052115 | A | C |
| S_9533607 \| \| scaffold14851_5052595_SNP | 5052595 | T | C |
| S_9533612 \| \| scaffold14851_5052703_SNP | 5052703 | C | A |
| S_9533782 \| \| scaffold14851_5057969_SNP | 5057969 | T | C |
| S_9533948 \| \| scaffold14851_5059250_SNP | 5059250 | G | A |
| S_9534126 \| \| scaffold14851_5061562_SNP | 5061562 | A | G |
| S_9534129 \| \| scaffold14851_5061648_SNP | 5061648 | C | T |
| S_9534198 \| \| scaffold14851_5062494_SNP | 5062494 | C | T |
| S_9534199 \| \| scaffold14851_5062497_SNP | 5062497 | T | C |
| S_9534235 \| \| scaffold14851_5063120_SNP | 5063120 | C | G |
| S_9534259 \| \| scaffold14851_5063410_SNP | 5063410 | T | C |
| S_9534262 \| \| scaffold14851_5063444_SNP | 5063444 | A | G |
| S_9534263 \| \| scaffold14851_5063446_SNP | 5063446 | A | C |
| S_9534294 \| \| scaffold14851_5063574_SNP | 5063574 | T | C |
| S_9534295 \| \| scaffold14851_5063576_SNP | 5063576 | A | G |
| S_9534326 \| \| scaffold14851_5063687_SNP | 5063687 | C | T |
| S_9534327 \| \| scaffold14851_5063690_SNP | 5063690 | C | T |
| S_9534328 \| \| scaffold14851_5063692_SNP | 5063692 | A | G |
| S_9534425 \| \| scaffold14851_5064936_SNP | 5064936 | A | G |
| S_9534524 \| \| scaffold14851_5065217_SNP | 5065217 | T | C |
| S_9534526 \| \| scaffold14851_5065248_SNP | 5065248 | A | G |
| S_9534748 \| \| scaffold14851_5069297_SNP | 5069297 | A | T |

TABLE 1-continued

SNP Positions within SEQ ID NO: 1 that are associated with increased resistance to ASR

| Name | Position SEQ ID NO: 1 | Favorabale Allele (Rust Resistant) | Unfavorable Allele (Rust Susceptible) |
|---|---|---|---|
| S_9534770 \| \| scaffold14851_5069467_SNP | 5069467 | A | G |
| S_9534864 \| \| scaffold14851_5070369_SNP | 5070369 | T | C |
| S_9534875 \| \| scaffold14851_5070537_SNP | 5070537 | A | G |
| S_9534913 \| \| scaffold14851_5071007_SNP | 5071007 | A | G |
| S_9534937 \| \| scaffold14851_5071215_SNP | 5071215 | C | T |
| S_9534938 \| \| scaffold14851_5071254_SNP | 5071254 | C | T |
| S_9535054 \| \| scaffold14851_5073143_SNP | 5073143 | C | T |
| S_9535076 \| \| scaffold14851_5073430_SNP | 5073430 | A | C |
| S_9535404 \| \| scaffold14851_5076755_SNP | 5076755 | T | C |
| S_9535405 \| \| scaffold14851_5076756_SNP | 5076756 | C | G |
| S_9535543 \| \| scaffold14851_5077635_SNP | 5077635 | T | G |
| S_9535674 \| \| scaffold14851_5078863_SNP | 5078863 | T | C |
| S_9535675 \| \| scaffold14851_5078883_SNP | 5078883 | T | C |
| S_9535950 \| \| scaffold14851_5082024_SNP | 5082024 | G | A |
| S_9535965 \| \| scaffold14851_5082263_SNP | 5082263 | T | G |
| S_9536781 \| \| scaffold14851_5092454_SNP | 5092454 | C | G |
| S_9536840 \| \| scaffold14851_5093421_SNP | 5093421 | A | T |
| S_9536956 \| \| scaffold14851_5095043_SNP | 5095043 | C | T |
| S_9537246 \| \| scaffold14851_5099641_SNP | 5099641 | T | G |
| S_9537407 \| \| scaffold14851_5102531_SNP | 5102531 | A | T |
| S_9538041 \| \| scaffold14851_5111660_SNP | 5111660 | A | T |
| S_9538469 \| \| scaffold14851_5118189_SNP | 5118189 | C | G |
| S_9538724 \| \| scaffold14851_5121082_SNP | 5121082 | T | C |
| S_9538976 \| \| scaffold14851_5124755_SNP | 5124755 | T | C |
| S_9539124 \| \| scaffold14851_5126954_SNP | 5126954 | A | G |
| S_9539301 \| \| scaffold14851_5129046_SNP | 5129046 | G | A |
| S_9539430 \| \| scaffold14851_5130678_SNP | 5130678 | G | C |
| S_9539441 \| \| scaffold14851_5130891_SNP | 5130891 | C | A |
| S_9539688 \| \| scaffold14851_5133044_SNP | 5133044 | G | A |
| S_9539837 \| \| scaffold14851_5135015_SNP | 5135015 | T | G |
| S_9539848 \| \| scaffold14851_5135167_SNP | 5135167 | G | A |
| S_9540002 \| \| scaffold14851_5137706_SNP | 5137706 | A | G |
| S_9540595 \| \| scaffold14851_5145034_SNP | 5145034 | T | C |
| S_9540718 \| \| scaffold14851_5146238_SNP | 5146238 | A | G |
| S_9540745 \| \| scaffold14851_5146506_SNP | 5146506 | A | C |
| S_9540977 \| \| scaffold14851_5147242_SNP | 5147242 | A | G |
| S_9541238 \| \| scaffold14851_5147742_SNP | 5147742 | T | C |
| S_9541397 \| \| scaffold14851_5148433_SNP | 5148433 | G | A |
| S_9541865 \| \| scaffold14851_5150716_SNP | 5150716 | A | G |
| S_9541866 \| \| scaffold14851_5150720_SNP | 5150720 | C | T |
| S_9541870 \| \| scaffold14851_5150782_SNP | 5150782 | T | C |
| S_9542272 \| \| scaffold14851_5154104_SNP | 5154104 | A | G |
| S_9542302 \| \| scaffold14851_5154462_SNP | 5154462 | A | G |
| S_9542315 \| \| scaffold14851_5154597_SNP | 5154597 | G | T |
| scaffold14851_5154944_SNP | 5154944 | C | T |
| S_9542575 \| \| scaffold14851_5156318_SNP | 5156318 | T | C |
| S_9542617 \| \| scaffold14851_5156977_SNP | 5156977 | T | C |
| S_9542875 \| \| scaffold14851_5159802_SNP | 5159802 | A | G |
| S_9542953 \| \| scaffold14851_5160657_SNP | 5160657 | T | C |
| S_9543329 \| \| scaffold14851_5163762_SNP | 5163762 | A | G |

It is well known in the art that given the sequence and the SNP allele associated with a given trait (e.g. ASR resistance), one having ordinary skill in the art could develop oligonucleotide primers and use said primers to identify plants carrying any one of the chromosomal intervals depicted in SEQ ID NO: 1. A TAQMAN® assay (e.g. generally a two-step allelic discrimination assay or similar), a KASP™ assay (generally a one-step allelic discrimination assay defined below or similar), or both can be employed to assay the SNPs as disclosed herein. In an exemplary two-step assay, a forward primer, a reverse primer, and two assay probes (or hybridization oligos) are employed. The forward and reverse primers are employed to amplify genetic loci that comprise SNPs that are associated with ASR resistance loci. The particular nucleotides that are present at the SNP positions are then assayed using the assay primers (which in some embodiments are differentially labeled with, for example, fluorophores to permit distinguishing between the two assay probes in a single reaction), which in each pair differ from each other with respect to the nucleotides that are present at the SNP position (although it is noted that in any given pair, the probes can differ in their 5' or 3' ends without impacting their abilities to differentiate between nucleotides present at the corresponding SNP positions). In some embodiments, the assay primers and the reaction conditions are designed such that an assay primer will only hybridize to the reverse complement of a 100% perfectly matched sequence, thereby permitting identification of which allele(s) is/are present based upon detection of hybridizations.

Compositions and methods for identifying, selecting and producing Glycine plants (including wild Glycines and Glycine max lines) with enhanced disease resistance are provided. Disease resistant soybean plants and germplasms are also provided.

In some embodiments, methods of identifying a disease resistant soybean plant or germplasm are provided. Such methods may comprise detecting, in the soybean plant or germplasm, a genetic loci or molecular marker (e.g. SNP or a Quantitative Trait Loci (QTL)) associated with enhanced disease resistance, in particular ASR resistance. In some embodiments the genetic loci or molecular marker associates with the presence of a chromosomal interval comprising the nucleotide sequence or a portion thereof of SEQ ID NO: 1.

In some embodiments, methods of producing a disease resistant soybean plant are provided. Such methods may comprise detecting, in a soybean germplasm, the presence of a genetic loci and/or a genetic marker associated with enhanced pathogen resistance (e.g. ASR) and producing a progeny plant from said soybean germplasm.

In some embodiments, methods of selecting a disease resistant soybean plant or germplasm are provided. Such methods may comprise crossing a first soybean plant or germplasm with a second soybean plant or germplasm, wherein the first soybean plant or germplasm comprises a genetic loci derived from soybean *Glycine clandestina* accession PI339656, or a progeny thereof comprising any one of SEQ ID NO: 1 or a portion thereof associated with enhanced disease resistance and/or tolerance, and selecting a progeny plant or germplasm that possesses the genetic loci. In further embodiments, the first soybean plant or germplasm comprises a genetic loci derived from soybean *Glycine clandestina* accession PI591576.

In some embodiments, methods of introgressing a genetic loci derived from soybean accession number PI339656, PI591576, or a progeny thereof associated with enhanced pathogen resistance into a soybean plant or germplasm are provided. Such methods may comprise crossing a first soybean plant or germplasm comprising a chromosomal interval derived from soybean accession number PI339656, PI591576 or a progeny thereof associated with enhanced pathogen resistance with a second soybean plant or germplasm that lacks said genetic loci and optionally repeatedly backcrossing progeny plants comprising said genetic allele with the second soybean plant or germplasm to produce an soybean plant (e.g. *Glycine max*) or germplasm with enhanced pathogen resistance comprising the chromosomal interval derived from soybean accession number PI339656, PI591576 or a progeny thereof associated with enhanced pathogen resistance. Progeny comprising the chromosomal interval associated with enhanced pathogen resistance may be identified by detecting, in their genomes, the presence of a marker associated with said chromosomal interval derived from soybean accession number PI339656, PI591576 or a progeny thereof wherein said chromosomal interval comprises SEQ ID NO: 1 or a portion thereof. R-Genes from PI339656, PI591576 or a progeny thereof can be introgressed into a *Glycine max* line through the use of embryo rescue methods known by those skilled in the art for example as is disclosed in U.S. Pat. No. 7,842,850 herein incorporated by reference and through methods as described in the working Examples herein.

In some embodiments, a plant, a progeny plant, or plant part of the species *Glycine max* is provided, wherein a portion of a genome of the plant is obtained from a wild glycine species through the use of chemically induced chromosome doubling, and wherein said portion confers the plant with increased resistance to ASR as compared to a control plant not comprising the portion.

In some embodiments, a plant, progeny plant, or plant part of the species *Glycine max* is provided, wherein a genome of the plant comprises a chromosomal interval that confers increased resistance to ASR as compared to a control plant not comprising the interval, wherein said chromosomal interval is introduced into the plant from a wild glycine species, and wherein said plant with said chromosomal interval is obtained through chemically induced chromosomal doubling.

Soybean plants and/or germplasms identified, produced or selected by the methods of this invention are also provided, as are any progeny and/or seeds derived from a soybean plant or germplasm identified, produced or selected by these methods. In one embodiment a molecular markers associating with the presence of a chromosomal intervals depicted in SEQ ID NO: 1 may be used to identify or select for plant lines resistant to ASR. Further said molecular markers may be located within 20 cM, 10 cM, 5 cM, 4 cM, 3 cM, 2 cM, 1 cM of said chromosomal interval. In another embodiment, said molecular marker may be located within 20 cM, 10 cM, 5 cM, 4 cM, 3 cM, 2 cM, 1 cM of any SNP markers associated with ASR as described in Table 1.

Non-naturally occurring soybean seeds, plants and/or germplasms comprising one or genetic loci derived from soybean plant accession number PI339656, PI591576 or a progeny thereof associated with enhanced pathogen resistance (e.g. ASR, Cyst Nematode, *Phytophtora*, brown stem rot etc.) are also provided.

A marker associated with enhanced pathogen resistance may comprise, consist essentially of or consist of a single allele or a combination of alleles at one or more genetic loci derived from PI339656, PI591576 or a progeny thereof that associate with enhanced pathogen resistance. In one embodiment the marker is within a chromosomal interval as described by SEQ ID NO: 1.

The foregoing and other objects and aspects of the present invention are explained in detail in the drawings and specification set forth below.

BRIEF DESCRIPTION OF THE DRAWINGS

FIG. 1 shows the screening of Wild Glycine lines for rust resistance against a panel of 16 rust isolates.

FIG. 2 illustrates the rust rating scale used to measure plant phenotype.

FIG. 3 shows a depiction of *Glycine clandestina* (PI339656) SNPs associated with ASR Resistance on scaffold 14851 and scaffold 9588.

FIG. 4 is mapping interval within scaffold 14851 of markers associated with ASR FIG. 5 is a marker association map for *Glycine clandestina* (PI339656) where bands indicate regions/intervals of respective chromosomes associated with ASR resistance.

DETAILED DESCRIPTION OF THE INVENTION

The presently disclosed subject matter relates at least in part to the identification of a genomic region (i.e. chromosomal interval) derived from *Glycine clandestina* accession line PI339656, PI591576 or a progeny thereof associated with enhanced pathogen resistance (e.g. Asian soy rust or Soybean cyst nematode). As such, said chromosomal interval from PI339656, PI591576 or a progeny thereof, may be introgressed into *Glycine max* lines via somatic embryo rescue (see for example U.S. Patent Publication 2007/0261139 and examples herein) or through the use of a *Glycine max* donor line having introgressed into its genome the genetic region from PI339656, PI591576 or a progeny thereof wherein the region comprises SEQ ID NO: 1 or a portion thereof where presence of said genetic region is associated with increased soybean disease resistance to, for example, ASR, SCN, Stem termination, Stem Canker, Bacterial pustule, root knot nematode, brown stem rot, frogeye leaf spot, or phytophthora. In another embodiment a chromosomal interval derived from PI339656, PI591576 or a progeny thereof is introduced into a *Glycine max* line not comprising said chromosomal interval wherein said introduction confers in the *Glycine max* line or it's progeny increased resistances to disease (e.g. ASR) wherein the said chromosome interval is derived from chromosome 1, 2 3, 4, 5, 6, 7, 8, 9, 10, 11, 12, 13, 14, 15, 16, 17, 18, 19, or chromosome 20 of *Glycine clandestina* and further wherein said chromosomal interval comprises at least one allele that associates with the trait of increased disease resistance wherein said allele is any one of the alleles respectively selected from any one as depicted in Table 1.

All references listed below, as well as all references cited in the instant disclosure, including but not limited to all patents, patent applications and publications thereof, scientific journal articles, and database entries (e.g., GEN-BANK® database entries and all annotations available therein) are incorporated herein by reference in their entireties to the extent that they supplement, explain, provide a background for, or teach methodology, techniques, and/or compositions employed herein.

Definitions

Unless defined otherwise, all technical and scientific terms used herein have the same meaning as commonly understood to one of ordinary skill in the art to which the presently disclosed subject matter belongs.

Although the following terms are believed to be well understood by one of ordinary skill in the art, the following definitions are set forth to facilitate understanding of the presently disclosed subject matter.

As used herein, the terms "a" or "an" or "the" may refer to one or more than one. For example, "a" marker can mean one marker or a plurality of markers.

As used herein, the term "and/or" refers to and encompasses any and all possible combinations of one or more of the associated listed items, as well as the lack of combinations when interpreted in the alternative ("or").

As used herein, the term "about," when used in reference to a measurable value such as an amount of mass, dose, time, temperature, and the like, is meant to encompass variations of 20%, 10%, 5%, 1%, 0.5%, or even 0.1% of the specified amount.

The term "consists essentially of" (and grammatical variants thereof), as applied to a polynucleotide sequence of this invention, means a polynucleotide sequence that consists of both the recited sequence (e.g., SEQ ID NO: 1) and a total of ten or less (e.g., 1, 2, 3, 4, 5, 6, 7, 8, 9, or 10) additional nucleotides on the 5' and/or 3' ends of the recited sequence such that the function of the polynucleotide is not materially altered. The total of ten or less additional nucleotides includes the total number of additional nucleotides on both ends added together. The term "materially altered," as applied to polynucleotides of the invention, refers to an increase or decrease in ability to express the polynucleotide sequence of at least about 50% or more as compared to the expression level of a polynucleotide sequence consisting of the recited sequence.

As used herein, the term "wild glycine" refers to a *Glycine clandestina* plant.

As used herein, the term "allele" refers to one of two or more different nucleotides or nucleotide sequences that occur at a specific locus.

A marker is "associated with" a trait when it is linked to it and when the presence of the marker is an indicator of whether and/or to what extent the desired trait or trait form will occur in a plant/germplasm comprising the marker. Similarly, a marker is "associated with" an allele when it is linked to it and when the presence of the marker is an indicator of whether the allele is present in a plant/germplasm comprising the marker. For example, "a marker associated with enhanced pathogen resistance" refers to a marker whose presence or absence can be used to predict whether and/or to what extent a plant will display an pathogen resistant phenotype.

As used herein, the terms "backcross" and "backcrossing" refer to the process whereby a progeny plant is repeatedly crossed back to one of its parents. In a backcrossing scheme, the "donor" parent refers to the parental plant with the desired gene or locus to be introgressed. The "recipient" parent (used one or more times) or "recurrent" parent (used two or more times) refers to the parental plant into which the gene or locus is being introgressed. For example, see Ragot, M. et al. *Marker-assisted Backcrossing: A Practical Example*, in TECHNIQUES ET UTILISATIONS DES MARQUEURS MOLECULAIRES LES COLLOQUES, Vol. 72, pp. 45-56 (1995); and Openshaw et al., *Marker-assisted Selection in Backcross Breeding*, in PROCEEDINGS OF THE SYMPOSIUM "ANALYSIS OF MOLECULAR MARKER DATA," pp. 41-43 (1994). The initial cross gives rise to the F1 generation. The term "BC1" refers to the second use of the recurrent parent, "BC2" refers to the third use of the recurrent parent, and so on.

A centimorgan ("cM") is a unit of measure of recombination frequency. One cM is equal to a 1% chance that a marker at one genetic locus will be separated from a marker at a second locus due to crossing over in a single generation.

As used herein, the term "chromosomal interval defined by and including," used in reference to particular loci and/or alleles, refers to a chromosomal interval delimited by and encompassing the stated loci/alleles.

As used herein, the terms "cross" or "crossed" refer to the fusion of gametes via pollination to produce progeny (e.g., cells, seeds or plants). The term encompasses both sexual crosses (the pollination of one plant by another) and selfing (self-pollination, e.g., when the pollen and ovule are from the same plant). The term "crossing" refers to the act of fusing gametes via pollination to produce progeny.

As used herein, the terms "cultivar" and "variety" refer to a group of similar plants that by structural or genetic features and/or performance can be distinguished from other varieties within the same species.

As used herein, the terms "desired allele" and "allele of interest" are used interchangeably to refer to an allele associated with a desired trait. In some embodiments, a "desired allele" and/or "allele of interest" may be associated with either an increase or a decrease of or in a given trait, depending on the nature of the desired phenotype. In some embodiments, a "desired allele" and/or "allele of interest" may be associated with a change in morphology, color, etc.

As used herein, the terms "enhanced pathogen resistance" or "enhanced disease resistance" refers to an improvement, enhancement, or increase in a plant's ability to endure and/or thrive despite being infected with a disease (e.g. Asian soybean rust) as compared to one or more control plants (e.g., one or both of the parents, or a plant lacking a marker associated with enhanced pathogen resistance to respective pathogen/disease). Enhanced disease resistance includes any mechanism (other than whole-plant immunity or resistance) that reduces the expression of symptoms indicative of infection for a respective disease such as Asian soybean rust, soybean cyst nematode, *Phytophthora*, etc.

As used herein, the terms "elite" and "elite line" refer to any line that has resulted from breeding and selection for desirable agronomic performance. An elite line may be substantially homozygous. Numerous elite lines are available and known to those of skill in the art.

As used herein, the term "elite germplasm" refers to any germplasm that is derived from or is capable of giving rise to an elite plant.

As used herein, the terms "exotic," "exotic line" and "exotic germplasm" refer to any plant, line or germplasm that is not elite. In general, exotic plants/germplasms are not derived from any known elite plant or germplasm, but rather are selected to introduce one or more desired genetic elements into a breeding program (e.g., to introduce novel alleles into a breeding program).

A "genetic map" is a description of genetic linkage relationships among loci on one or more chromosomes within a given species, generally depicted in a diagrammatic or tabular form. For each genetic map, distances between loci are measured by the recombination frequencies between them. Recombinations between loci can be detected using a variety of markers. A genetic map is a product of the mapping population, types of markers used, and the polymorphic potential of each marker between different populations. The order and genetic distances between loci can differ from one genetic map to another.

As used herein, the term "genotype" refers to the genetic constitution of an individual (or group of individuals) at one or more genetic loci, as contrasted with the observable and/or detectable and/or manifested trait (the phenotype). Genotype is defined by the allele(s) of one or more known loci that the individual has inherited from its parents. The term genotype can be used to refer to an individual's genetic constitution at a single locus, at multiple loci, or more generally, the term genotype can be used to refer to an individual's genetic make-up for all the genes in its genome. Genotypes can be indirectly characterized, e.g., using markers and/or directly characterized by nucleic acid sequencing.

As used herein, the term "germplasm" refers to genetic material of or from an individual (e.g., a plant), a group of individuals (e.g., a plant line, variety or family), or a clone derived from a line, variety, species, or culture. The germplasm can be part of an organism or cell, or can be separate from the organism or cell. In general, germplasm provides genetic material with a specific molecular makeup that provides a physical foundation for some or all of the hereditary qualities of an organism or cell culture. As used herein, germplasm may refer to seeds, cells (including protoplasts and calli) or tissues from which new plants may be grown, as well as plant parts that can be cultured into a whole plant (e.g., stems, buds, roots, leaves, etc.).

A "haplotype" is the genotype of an individual at a plurality of genetic loci, i.e., a combination of alleles. Typically, the genetic loci that define a haplotype are physically and genetically linked, i.e., on the same chromosome segment. The term "haplotype" can refer to polymorphisms at a particular locus, such as a single marker locus, or polymorphisms at multiple loci along a chromosomal segment.

As used herein, the term "heterozygous" refers to a genetic status wherein different alleles reside at corresponding loci on homologous chromosomes.

As used herein, the term "homozygous" refers to a genetic status wherein identical alleles reside at corresponding loci on homologous chromosomes.

As used herein, the term "hybrid" refers to a seed and/or plant produced when at least two genetically dissimilar parents are crossed.

As used herein, the term "inbred" refers to a substantially homozygous plant or variety. The term may refer to a plant or variety that is substantially homozygous throughout the entire genome or that is substantially homozygous with respect to a portion of the genome that is of particular interest.

As used herein, the term "indel" refers to an insertion or deletion in a pair of nucleotide sequences, wherein a first sequence may be referred to as having an insertion relative to a second sequence or the second sequence may be referred to as having a deletion relative to the first sequence.

As used herein, the terms "introgression," "introgressing" and "introgressed" refer to both the natural and artificial transmission of a desired allele or combination of desired alleles of a genetic locus or genetic loci from one genetic background to another. For example, a desired allele at a specified locus can be transmitted to at least one progeny via a sexual cross between two parents of the same species, where at least one of the parents has the desired allele in its genome. Alternatively, for example, transmission of an allele can occur by recombination between two donor genomes, e.g., in a fused protoplast, where at least one of the donor protoplasts has the desired allele in its genome. The desired allele may be a selected allele of a marker, a QTL, a transgene, or the like. Offspring comprising the desired allele can be repeatedly backcrossed to a line having a desired genetic background and selected for the desired allele, with the result being that the desired allele becomes fixed in the desired genetic background. For example, a marker associated with enhanced ASR tolerance may be introgressed from a donor into a recurrent parent that is not Disease resistant. The resulting offspring could then be repeatedly backcrossed and selected until the progeny possess the ASR tolerance allele(s) in the recurrent parent background.

As used herein, the term "linkage" refers to the degree with which one marker locus is associated with another marker locus or some other locus (for example, an ASR tolerance locus). The linkage relationship between a molecular marker and a phenotype may be given as a "probability" or "adjusted probability." Linkage can be expressed as a desired limit or range. For example, in some embodiments, any marker is linked (genetically and physically) to any other marker when the markers are separated by less than about 50, 40, 30, 25, 20, or 15 map units (or cM).

In some aspects of the present invention, it is advantageous to define a bracketed range of linkage, for example, from about 10 cM and about 20 cM, from about 10 cM and about 30 cM, or from about 10 cM and about 40 cM. The more closely a marker is linked to a second locus, the better an indicator for the second locus that marker becomes. Thus, "closely linked loci" such as a marker locus and a second locus display an inter-locus recombination frequency of about 10%, 9%, 8%, 7%, 6%, 5%, 4%, 3%, or 2% or less. In some embodiments, the relevant loci display a recombination frequency of about 1% or less, e.g., about 0.75%, 0.5%, 0.25% or less. Two loci that are localized to the same chromosome, and at such a distance that recombination between the two loci occurs at a frequency of less than about 10% (e.g., about 9%, 8%, 7%, 6%, 5%, 4%, 3%, 2%, 1%, 0.75%, 0.5%, or 0.25%, or less) may also be said to be "proximal to" each other. Since one cM is the distance between two markers that show a 1% recombination frequency, any marker is closely linked (genetically and physically) to any other marker that is in close proximity, e.g., at or less than about 10 cM distant. Two closely linked markers on the same chromosome may be positioned about 9, 8, 7, 6, 5, 4, 3, 2, 1, 0.75, 0.5 or 0.25 cM or less from each other.

As used herein, the term "linkage disequilibrium" refers to a non-random segregation of genetic loci or traits (or both). In either case, linkage disequilibrium implies that the relevant loci are within sufficient physical proximity along a length of a chromosome so that they segregate together with greater than random (i.e., non-random) frequency (in the case of co-segregating traits, the loci that underlie the traits are in sufficient proximity to each other). Markers that show linkage disequilibrium are considered linked. Linked loci co-segregate more than 50% of the time, e.g., from about 51% to about 100% of the time. In other words, two markers that co-segregate have a recombination frequency of less than 50% (and, by definition, are separated by less than 50 cM on the same chromosome). As used herein, linkage can be between two markers, or alternatively between a marker and a phenotype. A marker locus can be "associated with" (linked to) a trait, e.g., Asian Soybean Rust (herein 'ASR'). The degree of linkage of a molecular marker to a phenotypic trait is measured, e.g., as a statistical probability of co-segregation of that molecular marker with the phenotype.

Linkage disequilibrium is most commonly assessed using the measure $r^2$, which is calculated using the formula described by Hill and Robertson, *Theor. Appl. Genet.* 38:226 (1968). When $r^2=1$, complete linkage disequilibrium exists between the two marker loci, meaning that the markers have not been separated by recombination and have the same allele frequency. Values for $r^2$ above ⅓ indicate sufficiently strong linkage disequilibrium to be useful for mapping. Ardlie et al., *Nature Reviews Genetics* 3:299 (2002). Hence, alleles are in linkage disequilibrium when $r^2$ values between pairwise marker loci are greater than or equal to about 0.33, 0.4, 0.5, 0.6, 0.7, 0.8, 0.9, or 1.0.

As used herein, the term "linkage equilibrium" describes a situation where two markers independently segregate, i.e., sort among progeny randomly. Markers that show linkage equilibrium are considered unlinked (whether or not they lie on the same chromosome).

A "locus" is a position on a chromosome where a gene or marker or allele is located. In some embodiments, a locus may encompass one or more nucleotides.

As used herein, the terms "marker" and "genetic marker" are used interchangeably to refer to a nucleotide and/or a nucleotide sequence that has been associated with a phenotype, trait or trait form. In some embodiments, a marker may be associated with an allele or alleles of interest and may be indicative of the presence or absence of the allele or alleles of interest in a cell or organism. A marker may be, but is not limited to, an allele, a gene, a haplotype, a restriction fragment length polymorphism (RFLP), a simple sequence repeat (SSR), random amplified polymorphic DNA (RAPD), cleaved amplified polymorphic sequences (CAPS) (Rafalski and Tingey, *Trends in Genetics* 9:275 (1993)), an amplified fragment length polymorphism (AFLP) (Vos et al., *Nucleic Acids Res.* 23:4407 (1995)), a single nucleotide polymorphism (SNP) (Brookes, *Gene* 234:177 (1993)), a sequence-characterized amplified region (SCAR) (Paran and Michelmore, *Theor. Appl. Genet.* 85:985 (1993)), a sequence-tagged site (STS) (Onozaki et al., *Euphytica* 138: 255 (2004)), a single-stranded conformation polymorphism (SSCP) (Orita et al., *Proc. Natl. Acad. Sci. USA* 86:2766

(1989)), an inter-simple sequence repeat (ISSR) (Blair et al., *Theor. Appl. Genet.* 98:780 (1999)), an inter-retrotransposon amplified polymorphism (IRAP), a retrotransposon-microsatellite amplified polymorphism (REMAP) (Kalendar et al., *Theor. Appl. Genet.* 98:704 (1999)), a chromosome interval, or an RNA cleavage product (such as a Lynx tag). A marker may be present in genomic or expressed nucleic acids (e.g., ESTs). The term marker may also refer to nucleic acids used as probes or primers (e.g., primer pairs) for use in amplifying, hybridizing to and/or detecting nucleic acid molecules according to methods well known in the art. A large number of soybean molecular markers are known in the art, and are published or available from various sources, such as the SoyBase internet resource.

Markers corresponding to genetic polymorphisms between members of a population can be detected by methods well-established in the art. These include, e.g., nucleic acid sequencing, hybridization methods, amplification methods (e.g., PCR-based sequence specific amplification methods), detection of restriction fragment length polymorphisms (RFLP), detection of isozyme markers, detection of polynucleotide polymorphisms by allele specific hybridization (ASH), detection of amplified variable sequences of the plant genome, detection of self-sustained sequence replication, detection of simple sequence repeats (SSRs), detection of single nucleotide polymorphisms (SNPs), and/or detection of amplified fragment length polymorphisms (AFLPs). Well established methods are also known for the detection of expressed sequence tags (ESTs) and SSR markers derived from EST sequences and randomly amplified polymorphic DNA (RAPD).

A "marker allele," also described as an "allele of a marker locus," can refer to one of a plurality of polymorphic nucleotide sequences found at a marker locus in a population that is polymorphic for the marker locus.

"Marker-assisted selection" (MAS) is a process by which phenotypes are selected based on marker genotypes. In some embodiments, marker genotypes are used to identify plants that will be selected for a breeding program or for planting. In some embodiments, marker genotypes are used to identify plants that will not be selected for a breeding program or for planting (i.e., counter-selected plants), allowing them to be removed from the breeding/planting population.

As used herein, the terms "marker locus" and "marker loci" refer to a specific chromosome location or locations in the genome of an organism where a specific marker or markers can be found. A marker locus can be used to track the presence of a second linked locus, e.g., a linked locus that encodes or contributes to expression of a phenotypic trait. For example, a marker locus can be used to monitor segregation of alleles at a locus, such as a QTL or single gene, that are genetically or physically linked to the marker locus.

As used herein, the terms "marker probe" and "probe" refer to a nucleotide sequence or nucleic acid molecule that can be used to detect the presence of one or more particular alleles within a marker locus (e.g., a nucleic acid probe that is complementary to all of or a portion of the marker or marker locus, through nucleic acid hybridization). Marker probes comprising about 8, 10, 15, 20, 30, 40, 50, 60, 70, 80, 90, 100 or more contiguous nucleotides may be used for nucleic acid hybridization. Alternatively, in some aspects, a marker probe refers to a probe of any type that is able to distinguish (i.e., genotype) the particular allele that is present at a marker locus.

As used herein, the terms "molecular marker" or "genetic marker" may be used to refer to a genetic marker, as defined above, or an encoded product thereof (e.g., a protein) used as a point of reference when identifying a linked locus. A molecular marker can be derived from genomic nucleotide sequences or from expressed nucleotide sequences (e.g., from a spliced RNA, a cDNA, etc.). The term also refers to nucleotide sequences complementary to or flanking the marker sequences, such as nucleotide sequences used as probes and/or primers capable of amplifying the marker sequence. Nucleotide sequences are "complementary" when they specifically hybridize in solution, e.g., according to Watson-Crick base pairing rules. Some of the markers described herein are also referred to as hybridization markers when located on an indel region. This is because the insertion region is, by definition, a polymorphism vis-à-vis a plant without the insertion. Thus, the marker need only indicate whether the indel region is present or absent. Any suitable marker detection technology may be used to identify such a hybridization marker, e.g., SNP technology is used in the examples provided herein.

A "non-naturally occurring variety of soybean" is any variety of soybean that does not naturally exist in nature. A "non-naturally occurring variety of soybean" may be produced by any method known in the art, including, but not limited to, transforming a soybean plant or germplasm, transfecting a soybean plant or germplasm and crossing a naturally occurring variety of soybean with a non-naturally occurring variety of soybean. In some embodiments, a "non-naturally occurring variety of soybean" may comprise one of more heterologous nucleotide sequences. In some embodiments, a "non-naturally occurring variety of soybean" may comprise one or more non-naturally occurring copies of a naturally occurring nucleotide sequence (i.e., extraneous copies of a gene that naturally occurs in soybean). In some embodiments, a "non-naturally occurring variety of soybean" may comprise a non-natural combination of two or more naturally occurring nucleotide sequences (i.e., two or more naturally occurring genes that do not naturally occur in the same soybean, for instance genes not found in *Glycine max* lines).

As used herein, the terms "phenotype," "phenotypic trait" or "trait" refer to one or more traits and/or manifestations of an organism. The phenotype can be a manifestation that is observable to the naked eye, or by any other means of evaluation known in the art, e.g., microscopy, biochemical analysis, or an electromechanical assay. In some cases, a phenotype or trait is directly controlled by a single gene or genetic locus, i.e., a "single gene trait." In other cases, a phenotype or trait is the result of several genes. It is noted that, as used herein, the term "disease resistant phenotype" takes into account environmental conditions that might affect the respective disease such that the effect is real and reproducible.

As used herein, the term "plant" may refer to a whole plant, any part thereof, or a cell or tissue culture derived from a plant. Thus, the term "plant" can refer to any of: whole plants, plant components or organs (e.g., roots, stems, leaves, buds, flowers, pods, etc.), plant tissues, seeds and/or plant cells. A plant cell is a cell of a plant, taken from a plant, or derived through culture from a cell taken from a plant. Thus, the term "soybean plant" may refer to a whole soybean plant, one or more parts of a soybean plant (e.g., roots, root tips, stems, leaves, buds, flowers, pods, seeds, cotyledons, etc.), soybean plant cells, soybean plant protoplasts and/or soybean plant calli.

As used herein, the term "polymorphism" refers to a variation in the nucleotide sequence at a locus, where said variation is too common to be due merely to a spontaneous mutation. A polymorphism can be a single nucleotide polymorphism (SNP) or an insertion/deletion polymorphism, also referred to herein as an "indel." Additionally, the variation can be in a transcriptional profile or a methylation pattern. The polymorphic site or sites of a nucleotide sequence can be determined by comparing the nucleotide sequences at one or more loci in two or more germplasm entries.

As used herein, the term "population" refers to a genetically heterogeneous collection of plants sharing a common genetic derivation.

As used herein, the terms "progeny" and "progeny plant" refer to a plant generated from a vegetative or sexual reproduction from one or more parent plants. A progeny plant may be obtained by cloning or selfing a single parent plant, or by crossing two parental plants.

As used herein, the term "reference sequence" refers to a defined nucleotide sequence used as a basis for nucleotide sequence comparison. The reference sequence for a marker, for example, is obtained by genotyping a number of lines at the locus or loci of interest, aligning the nucleotide sequences in a sequence alignment program, and then obtaining the consensus sequence of the alignment. Hence, a reference sequence identifies the polymorphisms in alleles at a locus. A reference sequence may not be a copy of an actual nucleic acid sequence from any particular organism; however, it is useful for designing primers and probes for actual polymorphisms in the locus or loci.

As used herein, the terms "disease tolerance" and "Disease resistant" refer to a plant's ability to endure and/or thrive despite being infected with a respective disease. When used in reference to germplasm, the terms refer to the ability of a plant that arises from that germplasm to endure and/or thrive despite being infected with a respective disease. In some embodiments, infected Disease resistant soybean plants may yield as well (or nearly as well) as uninfected soybean plants. In general, a plant or germplasm is labeled as "Disease resistant" if it displays "enhanced pathogen resistance."

An "unfavorable allele" of a marker is a marker allele that segregates with the unfavorable plant phenotype, therefore providing the benefit of identifying plants that can be removed from a breeding program or planting.

"PI339656" refers to *Glycine clandestina* accession numbers PI339656, PI446934, PI483193, PI505154, PI595799, or PI591576.

Genetic Mapping

Genetic loci correlating with particular phenotypes, such as disease resistance, can be mapped in an organism's genome. By identifying a marker or cluster of markers that co-segregate with a trait of interest, the breeder is able to rapidly select a desired phenotype by selecting for the proper marker (a process called marker-assisted selection, or MAS). Such markers may also be used by breeders to design genotypes in silico and to practice whole genome selection.

The present invention provides markers associated with enhanced disease resistance. Detection of these markers and/or other linked markers can be used to identify, select and/or produce Disease resistant plants and/or to eliminate plants that are not Disease resistant from breeding programs or planting.

*Glycine Clandestina* Genetic Loci Associated with Enhanced Disease Resistance Markers associated with enhanced disease resistance are identified herein (see Table 1). A marker of the present invention may comprise a single allele or a combination of alleles at one or more genetic loci (for example, any marker combination from Table 1. For example, the marker may comprise one or more marker alleles located within a first chromosomal interval (e.g. SEQ ID NO: 1).

Markers of the present invention are described herein with respect to the positions of marker loci within chromosomal intervals comprising sequenced genomic DNA of PI339656, or a progeny thereof as depicted by any one of SEQ ID NO: 1: and as represented in Table 1.

Marker-Assisted Selection

Markers can be used in a variety of plant breeding applications. See, e.g., Staub et al., *Hortscience* 31: 729 (1996); Tanksley, *Plant Molecular Biology Reporter* 1: 3 (1983). One of the main areas of interest is to increase the efficiency of backcrossing and introgressing genes using marker-assisted selection (MAS). In general, MAS takes advantage of genetic markers that have been identified as having a significant likelihood of co-segregation with a desired trait. Such markers are presumed to be in/near the gene(s) that give rise to the desired phenotype, and their presence indicates that the plant will possess the desired trait. Plants which possess the marker are expected to transfer the desired phenotype to their progeny.

A marker that demonstrates linkage with a locus affecting a desired phenotypic trait provides a useful tool for the selection of the trait in a plant population. This is particularly true where the phenotype is hard to assay or occurs at a late stage in plant development. Since DNA marker assays are less laborious and take up less physical space than field phenotyping, much larger populations can be assayed, increasing the chances of finding a recombinant with the target segment from the donor line moved to the recipient line. The closer the linkage, the more useful the marker, as recombination is less likely to occur between the marker and the gene causing or imparting the trait. Having flanking markers decreases the chances that false positive selection will occur. The ideal situation is to have a marker within the causative gene itself, so that recombination cannot occur between the marker and the gene. Such a marker is called a "perfect marker."

When a gene is introgressed by MAS, it is not only the gene that is introduced but also the flanking regions. Gepts, *Crop Sci* 42:1780 (2002). This is referred to as "linkage drag." In the case where the donor plant is highly unrelated to the recipient plant, these flanking regions carry additional genes that may code for agronomically undesirable traits. This "linkage drag" may also result in reduced yield or other negative agronomic characteristics even after multiple cycles of backcrossing into the elite soybean line. This is also sometimes referred to as "yield drag." The size of the flanking region can be decreased by additional backcrossing, although this is not always successful, as breeders do not have control over the size of the region or the recombination breakpoints. Young et al., *Genetics* 120:579 (1998). In classical breeding, it is usually only by chance that recombinations that contribute to a reduction in the size of the donor segment are selected. Tanksley et al., *Biotechnology* 7: 257 (1989). Even after 20 backcrosses, one might find a sizeable piece of the donor chromosome still linked to the gene being selected. With markers, however, it is possible to select those rare individuals that have experienced recombination near the gene of interest. In 150 backcross plants, there is a 95% chance that at least one plant will have experienced a crossover within 1 cM of the gene, based on a single meiosis map distance. Markers allow for unequivocal identification of those individuals. With one additional backcross of 300 plants, there would be a 95% chance of a crossover within 1 cM single meiosis map distance of the other side of the gene, generating a segment around the target gene of less than 2 cM based on a single meiosis map distance. This can be accomplished in two generations with markers, while it would have required on average 100 generations without markers. See Tanksley et al., supra. When the exact location of a gene is known, flanking markers surrounding the gene can be utilized to select for recombinations in different population sizes. For example, in smaller population sizes, recombinations may be expected further away from the gene, so more distal flanking markers would be required to detect the recombination.

The availability of integrated linkage maps of the soybean genome containing increasing densities of public soybean markers has facilitated soybean genetic mapping and MAS.

Of all the molecular marker types, SNPs are the most abundant and have the potential to provide the highest genetic map resolution. Bhattramakki et al., *Plant Molec. Biol.* 48:539 (2002). SNPs can be assayed in a so-called "ultra-high-throughput" fashion because they do not require large amounts of nucleic acid and automation of the assay is straight-forward. SNPs also have the benefit of being relatively low-cost systems. These three factors together make SNPs highly attractive for use in MAS. Several methods are available for SNP genotyping, including but not limited to, hybridization, primer extension, oligonucleotide ligation, nuclease cleavage, mini-sequencing and coded spheres. Such methods have been reviewed in various publications: Gut, *Hum. Mutat.* 17:475 (2001); Shi, Clin. Chem. 47:164 (2001); Kwok, *Pharmacogenomics* 1:95 (2000); Bhattramakki and Rafalski, *Discovery and application of single nucleotide polymorphism markers in plants*, in PLANT GENOTYPING: THE DNA FINGERPRINTING OF PLANTS, CABI Publishing, Wallingford (2001). A wide range of commercially available technologies utilize these and other methods to interrogate SNPs, including Masscode™ (Qiagen, Germantown, MD), Invader® (Hologic, Madison, WI), SnapShot® (Applied Biosystems, Foster City, CA), Taqman® (Applied Biosystems, Foster City, CA) and Beadarrays™ (Illumina, San Diego, CA).

A number of SNP alleles together within a sequence, or across linked sequences, can be used to describe a haplotype for any particular genotype. Ching et al., *BMC Genet.* 3:19 (2002); Gupta et al., (2001), Rafalski, *Plant Sci.* 162:329 (2002b). Haplotypes can be more informative than single SNPs and can be more descriptive of any particular genotype. For example, a single SNP may be allele "T" for a specific Disease resistant line or variety, but the allele "T" might also occur in the soybean breeding population being utilized for recurrent parents. In this case, a combination of alleles at linked SNPs may be more informative. Once a unique haplotype has been assigned to a donor chromosomal region, that haplotype can be used in that population or any subset thereof to determine whether an individual has a particular gene. The use of automated high throughput marker detection platforms known to those of ordinary skill in the art makes this process highly efficient and effective.

The markers of the present invention can be used in marker-assisted selection protocols to identify and/or select progeny with enhanced Asian soybean rust tolerance. Such methods can comprise, consist essentially of or consist of crossing a first soybean plant or germplasm with a second soybean plant or germplasm, wherein the first soybean plant or germplasm comprises a chromosomal interval derived from PI339656, or a progeny thereof wherein said chromosomal interval corresponds with nucleotide base 1 to nucleotide base 5166731 of SEQ ID NO: 1 and selecting a progeny plant that possesses the marker. Either of the first and second soybean plants, or both, may be of a non-naturally occurring variety of soybean. In some embodiments, the second soybean plant or germplasm is of an elite variety of soybean. In some embodiments, the genome of the second soybean plant or germplasm is at least about 50%, 55%, 60%, 65%, 70%, 75%, 80%, 85%, 90%, 95%, 97%, 99% or 100% identical to that of an elite variety of soybean. In another embodiment, the first soybean plant comprises a chromosomal interval derived from PI339656, or a progeny thereof wherein said chromosomal interval corresponds with nucleotide base 1 to nucleotide base 5166731 of SEQ ID NO: 1 wherein the chromosome interval further comprises at least one allele as depicted in any one of respective Table 1.

Methods for identifying and/or selecting a disease resistant soybean plant or germplasm may comprise, consist essentially of or consist of detecting the presence of a marker associated with enhanced ASR tolerance. The marker may be detected in any sample taken from the plant or germplasm, including, but not limited to, the whole plant or germplasm, a portion of said plant or germplasm (e.g., a seed chip, a leaf punch disk or a cell from said plant or germplasm) or a nucleotide sequence from said plant or germplasm. Such a sample may be taken from the plant or germplasm using any present or future method known in the art, including, but not limited to, automated methods of removing a portion of endosperm with a sharp blade, drilling a small hole in the seed and collecting the resultant powder, cutting the seed with a laser and punching a leaf disk. The soybean plant may be of a non-naturally occurring variety of soybean. In some embodiments, the genome of the soybean plant or germplasm is at least about 50%, 55%, 60%, 65%, 70%, 75%, 80%, 85%, 90%, 95%, 97%, 99% or 100% identical to that of an elite variety of soybean.

In some embodiments, the marker detected in the sample may comprise, consist essentially of or consist of one or more marker alleles located within a chromosomal interval selected from the group consisting of:

1) A chromosomal interval derived from PI339656, or a progeny thereof wherein said chromosomal interval corresponds with nucleotide base 1 to nucleotide base 5166731 of SEQ ID NO: 1; or
2) chromosomal interval derived from PI339656, or a progeny thereof wherein said chromosomal interval comprises a portion of any one of the chromosome intervals described in 1) and wherein the chromosome interval comprises at least one SNP marker as demonstrated respectfully in any one of Table 1; or
3) A chromosomal interval spanning 20 cM, 15 cM, 10 cM, 5 cM, 1 cM, 0.5 cM from a SNP marker that associates with increased ASR resistance in soybean wherein the SNP marker is selected from the group consisting of any SNP marker displayed in any one of Table 1.

Methods for producing an disease resistant soybean plant may comprise, consist essentially of or consist of detecting, in a germplasm, a marker associated with enhanced disease resistance (e.g. ASR) wherein said marker is selected from any one of Table 1 or wherein marker is a closely linked loci of any marker described in any of Table 1 and producing a soybean plant from said germplasm. The marker may be detected in any sample taken from the germplasm, including, but not limited to, a portion of said germplasm (e.g., a seed chip or a cell from said germplasm) or a nucleotide sequence from said germplasm. Such a sample may be taken from the germplasm using any present or future method known in the art, including, but not limited to, automated methods of removing a portion of endosperm with a sharp blade, drilling a small hole in the seed and collecting the resultant powder, cutting the seed with a laser and punching a leaf disk. The germplasm may be of a non-naturally occurring variety of soybean. In some embodiments, the genome of the germplasm is at least about 50%, 55%, 60%, 65%, 70%, 75%, 80%, 85%, 90%, 95%, 97%, 99% or 100% identical to that of an elite variety of soybean. An Disease resistant soybean plant is then produced from the germplasm identified as having the marker associated with enhanced disease resistance (e.g. ASR) according to methods well known in the art for breeding and producing plants from germplasm.

In some embodiments, the marker detected in the germplasm may comprise, consist essentially of or consist of one or more marker alleles located within a chromosomal interval selected from the group consisting of:

1) A chromosomal interval derived from PI339656, or a progeny thereof wherein said chromosomal interval corresponds with nucleotide base 1 to nucleotide base 5166731 of SEQ ID NO: 1; or
2) chromosomal interval derived from PI339656, or a progeny thereof wherein said chromosomal interval comprises a portion of any one of the chromosome intervals described in 1) and wherein the chromosome interval comprises at least one SNP marker as demonstrated respectfully in any one of Table 1; or
3) A chromosomal interval spanning 20 cM, 15 cM, 10 cM, 5 cM, 1 cM, 0.5 cM from a SNP marker that associates with increased ASR resistance in soybean wherein the SNP marker is selected from the group consisting of any SNP marker displayed in any one of Table 1.

In some embodiments, the marker detected in the germplasm may comprise, consist essentially of or consist of one or more marker alleles selected from any one of Table 1.

Methods for producing and/or selecting an Asian soy rust resistant/tolerant soybean plant or germplasm may comprise crossing a first soybean plant or germplasm with a second soybean plant or germplasm, wherein said first soybean plant or germplasm comprises a chromosomal interval selected from the group consisting of:

1) A chromosomal interval derived from PI339656, or a progeny thereof wherein said chromosomal interval corresponds with nucleotide base 1 to nucleotide base 5166731 of SEQ ID NO: 1; or
2) chromosomal interval derived from PI339656, or a progeny thereof wherein said chromosomal interval comprises a portion of any one of the chromosome intervals described in 1) and wherein the chromosome interval comprises at least one SNP marker as demonstrated respectfully in any one of Table 1; or
3) A chromosomal interval spanning 20 cM, 15 cM, 10 cM, 5 cM, 1 cM, 0.5 cM from a SNP marker that associates with increased ASR resistance in soybean wherein the SNP marker is selected from the group consisting of any SNP marker displayed in any one of Table 1.

Also provided herein is a method of introgressing an allele associated with enhanced Disease (e.g. ASR, SCN, SDS, RKN, *Phytophtora*, etc.) resistance/tolerance (e.g. ASR, SCN, SDS, RKN, *Phytophtora*, etc.) into a soybean plant. Such methods for introgressing an allele associated with enhanced Disease (e.g. ASR, SCN, SDS, RKN, *Phy-*

*tophtora*, etc.) resistance/tolerance into a soybean plant or germplasm may comprise, consist essentially of or consist of crossing a first soybean plant or germplasm comprising said allele (the donor) wherein said allele is selected from any allele listed in Table 1 or a maker in "close proximity" to a marker listed in Table 1 with a second soybean plant or germplasm that lacks said allele (the recurrent parent) and repeatedly backcrossing progeny comprising said allele with the recurrent parent. Progeny comprising said allele may be identified by detecting, in their genomes, the presence of a marker associated with enhanced Disease (e.g. ASR, SCN, SDS, RKN, *Phytophtora*, etc.) resistance/tolerance. The marker may be detected in any sample taken from the progeny, including, but not limited to, a portion of said progeny (e.g., a seed chip, a leaf punch disk or a cell from said plant or germplasm) or a nucleotide sequence from said progeny. Such a sample may be taken from the progeny using any present or future method known in the art, including, but not limited to, automated methods of removing a portion of endosperm with a sharp blade, drilling a small hole in the seed and collecting the resultant powder, cutting the seed with a laser and punching a leaf disk. Either the donor or the recurrent parent, or both, may be of a non-naturally occurring variety of soybean. In some embodiments, the recurrent parent is of an elite variety of soybean. In some embodiments, the genome of the recurrent parent is at least about 50%, 55%, 60%, 65%, 70%, 75%, 80%, 85%, 90%, 95%, 97%, 99% or 100% identical to that of an elite variety of soybean.

In some embodiments, the marker used to identify progeny comprising an allele associated with enhanced Disease (e.g. ASR, SCN, SDS, RKN, *Phytophtora*, brown stem rot etc.) resistance/tolerance may comprise, consist essentially of or consist of one or more marker alleles located within a chromosomal interval selected from the group consisting of:

1) A chromosomal interval derived from PI339656, or a progeny thereof wherein said chromosomal interval corresponds with nucleotide base 1 to nucleotide base 5166731 of SEQ ID NO: 1; or
2) chromosomal interval derived from PI339656, or a progeny thereof wherein said chromosomal interval comprises a portion of any one of the chromosome intervals described in 1) and wherein the chromosome interval comprises at least one SNP marker as demonstrated respectfully in any one of Table 1; or
3) A chromosomal interval spanning 20 cM, 15 cM, 10 cM, 5 cM, 1 cM, 0.5 cM from a SNP marker that associates with increased ASR resistance in soybean wherein the SNP marker is selected from the group consisting of any SNP marker displayed in any one of Table 1.

In some embodiments, the marker may comprise, consist essentially of or consist of marker alleles located in at least two different chromosomal intervals. For example, the marker may comprise one or more alleles located in the chromosomal interval defined by and including any two markers in Table 1.

Disease Resistant Soybean Plants and Germplasms

The present invention provides Disease resistant soybean plants and germplasms. As discussed above, the methods of the present invention may be utilized to identify, produce and/or select a Disease resistant soybean plant or germplasm (for example a soybean plant resistant or having increased tolerance to Asian Soybean Rust). In addition to the methods described above, an Disease resistant soybean plant or germplasm may be produced by any method whereby a marker associated with enhanced Disease tolerance is introduced into the soybean plant or germplasm, including, but not limited to, transformation, protoplast transformation or fusion, a double haploid technique, embryo rescue, gene editing and/or by any other nucleic acid transfer system.

In some embodiments, the soybean plant or germplasm comprises a non-naturally occurring variety of soybean. In some embodiments, the soybean plant or germplasm is at least about 50%, 55%, 60%, 65%, 70%, 75%, 80%, 85%, 90%, 95%, 97%, 99% or 100% identical to that of an elite variety of soybean.

The Disease resistant soybean plant or germplasm may be the progeny of a cross between an elite variety of soybean and a variety of soybean that comprises an allele associated with enhanced Disease tolerance (e.g. ASR) wherein the allele is within a chromosomal interval selected from the group consisting of:

1) A chromosomal interval derived from PI339656, or a progeny thereof wherein said chromosomal interval corresponds with nucleotide base 1 to nucleotide base 5166731 of SEQ ID NO: 1; or
2) chromosomal interval derived from PI339656, or a progeny thereof wherein said chromosomal interval comprises a portion of any one of the chromosome intervals described in 1) and wherein the chromosome interval comprises at least one SNP marker as demonstrated respectfully in any one of Table 1; or
3) A chromosomal interval spanning 20 cM, 15 cM, 10 cM, 5 cM, 1 cM, 0.5 cM from a SNP marker that associates with increased ASR resistance in soybean wherein the SNP marker is selected from the group consisting of any SNP marker displayed in any one of Table 1.

The Disease resistant soybean plant or germplasm may be the progeny of an introgression wherein the recurrent parent is an elite variety of soybean and the donor comprises an allele associated with enhanced Disease tolerance and/or resistance wherein the donor carries a chromosomal interval or a portion thereof comprising any one of SEQ ID NO: 1 and wherein the chromosome interval comprises at least one allele selected respectively from Table 1.

The Disease resistant soybean plant or germplasm may be the progeny of a cross between a first elite variety of soybean (e.g., a tester line) and the progeny of a cross between a second elite variety of soybean (e.g., a recurrent parent) and a variety of soybean that comprises an allele associated with enhanced ASR tolerance (e.g., a donor).

The Disease resistant soybean plant or germplasm may be the progeny of a cross between a first elite variety of soybean and the progeny of an introgression wherein the recurrent parent is a second elite variety of soybean and the donor comprises an allele associated with enhanced ASR tolerance.

A Disease resistant soybean plant and germplasm of the present invention may comprise one or more markers of the present invention (e.g. any marker described in Table 1; or any marker in close proximity to any marker as described in Table 1).

In some embodiments, the Disease resistant soybean plant or germplasm may comprise within its genome, a marker associated with enhanced ASR tolerance, wherein said marker is located within a chromosomal interval selected from the group consisting of:

1) A chromosomal interval derived from PI339656, or a progeny thereof wherein said chromosomal interval corresponds with nucleotide base 1 to nucleotide base 5166731 of SEQ ID NO: 1; or 2) chromosomal interval derived from PI339656, or a progeny thereof wherein said chromosomal interval comprises a portion of any one of the chromosome intervals described in 1) and wherein the chromosome interval comprises at least one SNP marker as demonstrated respectfully in any one of Table 1; or 3) A chromosomal interval spanning 20 cM, 15 cM, 10 cM, 5 cM, 1 cM, 0.5 cM from a SNP marker that associates with increased ASR resistance in soybean wherein the SNP marker is selected from the group consisting of any SNP marker displayed in any one of Table 1.

In some embodiments, the Disease resistant soybean plant or germplasm may comprise within its genome a marker that comprises, consists essentially of or consists of marker alleles located in at least two different chromosomal intervals. For example, the marker may comprise one or more alleles located in the chromosomal interval defined by and including any combination of two markers of Table 1.

Disease Resistant Soybean Seeds

The present invention provides Disease resistant soybean seeds. As discussed above, the methods of the present invention may be utilized to identify, produce and/or select an Disease resistant soybean seed. In addition to the methods described above, an Disease resistant soybean seed may be produced by any method whereby a marker associated with enhanced ASR tolerance is introduced into the soybean seed, including, but not limited to, transformation, protoplast transformation or fusion, a double haploid technique, embryo rescue, genetic editing (e.g. CRISPR or TALEN or MegaNucleases) and/or by any other nucleic acid transfer system.

In some embodiments, the Disease resistant soybean seed comprises a non-naturally occurring variety of soybean. In some embodiments, the soybean seed is at least about 50%, 55%, 60%, 65%, 70%, 75%, 80%, 85%, 90%, 95%, 97%, 99% or 100% identical to that of an elite variety of soybean.

The Disease resistant soybean seed may be produced by an Disease resistant soybean plant identified, produced or selected by the methods of the present invention. In some embodiments, the Disease resistant soybean seed is produced by an Disease resistant soybean plant of the present invention.

A Disease resistant soybean seed of the present invention may comprise one or more markers from Table 1 of the present invention.

In some embodiments, the Disease resistant soybean seed may comprise within its genome, a marker associated with enhanced ASR tolerance, wherein said marker is located within a chromosomal interval selected from the group consisting of:

1) A chromosomal interval derived from PI339656, or a progeny thereof wherein said chromosomal interval corresponds with nucleotide base 1 to nucleotide base 5166731 of SEQ ID NO: 1; or 2) chromosomal interval derived from PI339656, or a progeny thereof wherein said chromosomal interval comprises a portion of any one of the chromosome intervals described in 1) and wherein the chromosome interval comprises at least one SNP marker as demonstrated respectfully in any one of Table 1; or 3) A chromosomal interval spanning 20 cM, 15 cM, 10 cM, 5 cM, 1 cM, 0.5 cM from a SNP marker that associates with increased ASR resistance in soybean wherein the SNP marker is selected from the group consisting of any SNP marker displayed in any one of Table 1.

EXAMPLES

The following examples are not intended to be a detailed catalog of all the different ways in which the present invention may be implemented or of all the features that may be added to the present invention. Persons skilled in the art will appreciate that numerous variations and additions to the various embodiments may be made without departing from the present invention. Hence, the following descriptions are intended to illustrate some particular embodiments of the invention, and not to exhaustively specify all permutations, combinations and variations thereof.

Example 1 Identification of ASR Resistant Wild Glycine Lines

Figure 1:
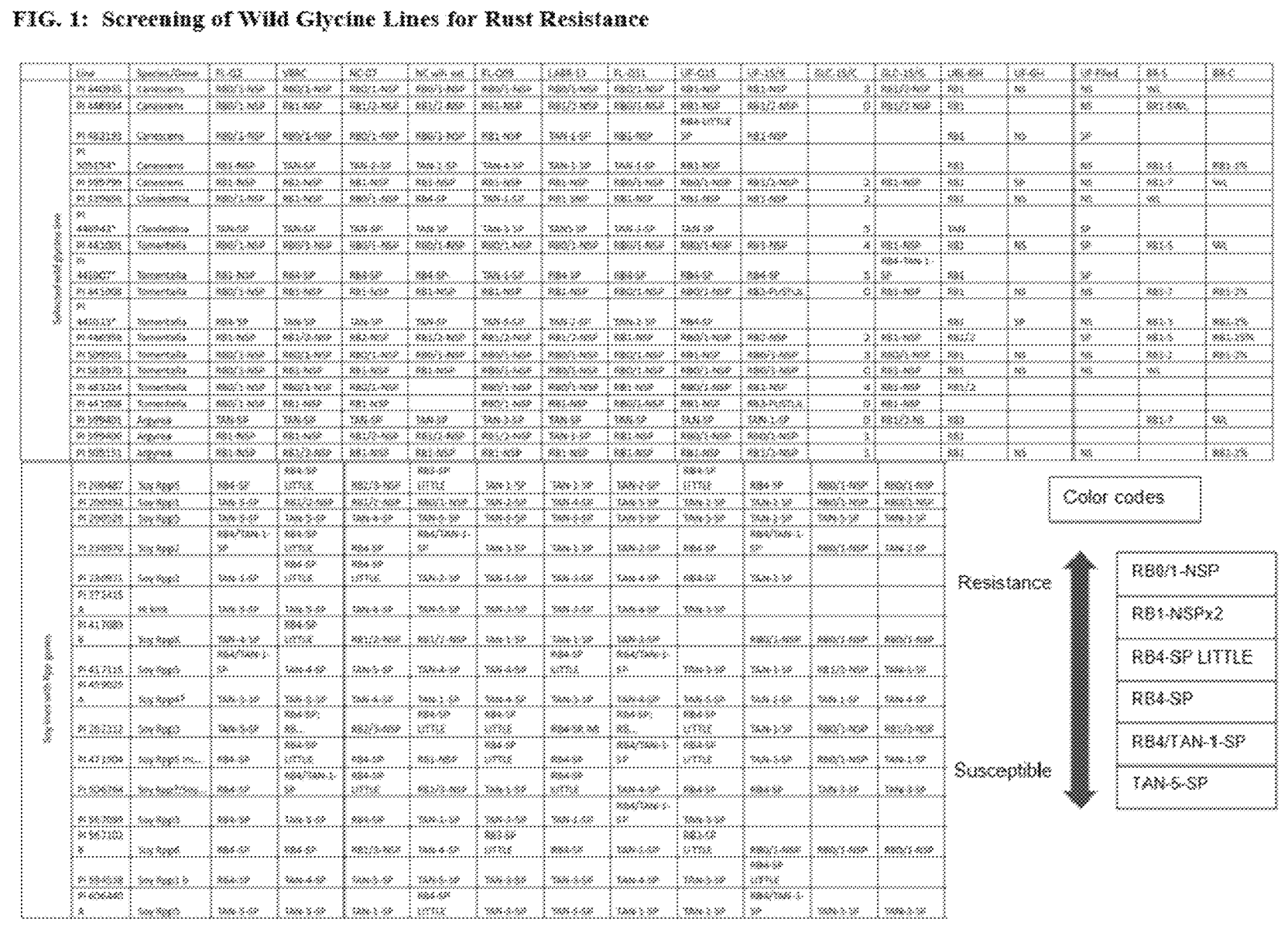

Wild glycine lines were evaluated for rust resistance against sixteen rust strains (See FIG. 1). The rust data were generated using single pustule derived isolates from USDA-ARS (FL Q09, FL Q12, LABR13, FLQ11) and field populations (FL Q15, NC06, Vero, GLC15, UBL, BR south and BR central), the screening was carried out in contained facilities.

The rust rating is categorized based on groupings modified from Burdon and Speer, T A G, 1984 (see FIG. 2). Each accession was screened >2 times with ~4 plants each time in North & South America.

Example 2 Allele Mining & Associations to PI339656 ASR Loci

The resistant parent was crossed to a susceptible G. clandestina line and an F1 plant was generated (See Table 2). The F1 plant was self-fertilized and F2 seed was harvested from the selfed F1 plant. Around 200 F2 seed were sown and leaf tissue from each plant was collected for DNA preps and then the plants were inoculated with Phakopsora pachyrhizi to determine the resistance/susceptible phenotype of each F2 individual. Tissue from 50 resistant F2s and 50 susceptible F2s were combined in separate pools and genomic DNA was prepared from each pool. Illumina sequencing libraries were prepared from DNA for each of the pools and each library was sequenced in two Illumina HiSeq2000 2×100 bp Paired-End (PE) lanes. The sequencing reads were trimmed to remove bases with PHRED quality scores of <15.

As one non-limiting example, an ASR resistance phenotype may include the formation of lesions without spores on leaves of a plant exposed to ASR, while an ASR susceptible phenotype includes the formation of spores on the leaves of a plant exposed to ASR. Still other phenotypes may be used to distinguish ASR resistant plants from susceptible plants.

Quality trimmed reads were aligned to the PI339656 reference genome sequence using GSNAP (WU and NACU 2010) as paired-end fragments. If a pair of reads could not be aligned together, they were treated as singletons for alignment. Reads were used in subsequent analyses if they mapped uniquely to the reference (≤2 mismatches every 36 bp and less than 5 bases for every 75 bp as tails).

SNPs were filtered prior to BSA analysis based on read depth, with SNPs having between 40 and 200× read depth being retained. A Chi-square test was used to select SNPs with significantly different read counts between the two alleles in the two pools. An empirical Bayesian approach (LIU et al. 2012) was used to estimate the conditional probability that there is no recombination between each SNP marker and the causal locus in both the resistant pool and in the susceptible pool. The probability of the linkage between the SNP and the causal gene is the geometric mean of these two conditional probabilities. Around 780 SNPs were found to have possible linkage to the target locus. A subset of these putatively linked SNPs was used to fine map the locus using phenotyped F2 individuals.

See references: LIU, S., C.-T. YEH, H. M. TANG, D. NETTLETON AND P. S. SCHNABLE, 2012 Gene Mapping via Bulked Segregant RNA-Seq (BSR-Seq). PLoS ONE 7: e36406 & Wu, T. D., and S. Nacu, 2010 Fast and SNP-tolerant detection of complex variants and splicing in short reads. Bioinformatics 26: 873-881.

TABLE 8

| | | | | |
|---|---|---|---|---|
| | | Plant Crossings & Study Type | | |
| Species | PI# (male) | PI # (female | Study Type | F2: Resistant to Susceptible Ratio |
| G. clandestina | PI 339656 | PI 446943 | BSA | 3 to 1 |

1. PI339656 Data2Bio LLC (Ames, Iowa) Lab Methodology for gBSA-Seq Analysis for Tetraploid Soybean.

Chromosome discovery for causal loci in the tetraploid soybean population,

PI339656 was carried out using Data2Bio's Genomic Bulked Segregant Analysis (gBSA) technology. It was theorized that resistance is controlled by a single dominant allele. Data2Bio generated several libraries from DNA samples extracted from two susceptible tissue pools and two resistant tissue pools and sequenced these in eight (8) Illumina HiSeq2000 2×100 bp Paired-End (PE) lanes. A summary of the reference genomes used for subsequent analyses, read processing from raw data to quality trimming, alignment, SNP discovery and SNP impact are demonstrated in FIGS. 3-5. After various filtering steps 4,610,234 informative SNPs were identified in the PI339656 genome. A Bayesian approach was then used to calculate trait-associated probabilities. Next, physical maps of trait-associated SNPs (probability cutoff 0.01) for the top contigs were created (FIGS. 3-5). One scaffold, scaffold 14851, was identified and mapped to chromosome 14 of PI339656 (SEQ ID NO: 1). SNPs from this enriched scaffold were mapped to the public G. max genome. The data suggest that the causative Rgene may map within or near the interval from 3.18 to 3.5 MB on chromosome 14.

Example 3 Embryo Rescue & Introgression of R Gene Intervals into Glycine max Lines Embryo rescue is performed and chemical treatment is applied in order to generate amphidiploid shoots. If the amphidiploid plants are fertile they will be used to backcross with G. max. Backcrossing with G. max and subsequent embryo rescue will need to be performed for several generations in order to gradually eliminate the perennial Glycine chromosomes.

Wide crosses: Elite Syngenta soybean lines (RM 3.7 to 4.8) are used as the females (pollen recipients) and multiple accessions of Glycine clandestina are used as the males or pollen donors. Selecting flowers from the glycine plant containing anthers at the proper developmental stage is important. New, fully-opened, brightly colored flowers hold anthers with mature pollen. The pollen should appear as loose, yellow dust. These flowers are removed from the glycine plant and taken to the soybean plant for pollination. Pollen from the Glycine plants should be used within 30 minutes of flower removal. It is also important to identify and select soybean flower buds that are ready for pollination. A soybean flower bud is generally ready when it is larger in size when compared to an immature bud. The sepals of the soybean blossoms are lighter in color and the petals are just beginning to appear. First, use a pair of fine-tipped tweezers to carefully detach the sepals from the flower bud to expose the outer set of petals. Then gently grasp and remove the petals (5 in total) from the flower exposing the ring of stamens surrounding the pistil. Since the stigma is receptive to pollen 1 day before the anthers begin shedding pollen it is important to recognize the stage development of "female ready, male not ready". When pollinating soybean flowers at this developmental stage it is not necessary to emasculate the female flower. Locate the stigma on the soybean flower. Then using 1 male flower, carefully peel off the petals to expose the anthers and gently dust the pollen grains onto the stigma of the soybean flower. Care should be taken not to damage the stigma at any time during this process. Starting the day after pollination a hormone mixture is sprayed onto the pollinated flower and eventual developing F1 pod 1× every day until harvest. The pollinated flower or pod is saturated with a light mist of the hormone mixture, taking care not to cause the flower/pod to prematurely detach from the plant. The mixture contains 100 mg GA3, 25 mg NAA and 5 mg kinetin/L distilled water. These hormones aid in the retention of the developing pod and in increased pod growth.

Harvest: Pods from wide crosses are harvested at approximately 14 to 16 days post pollination. Harvest dates in the literature suggest 19 to 21 days. Pod harvest at 14 to 16 days after pollination is ~5 days earlier than suggested in literature, reducing timeline. Before selecting an individual pod to harvest verify that the sepals were removed (this indicates a wide cross attempt) and that the seed size is as expected for a wide cross. Pods are collected and counted according to wide cross combination to determine crossing success. The average crossing success across multiple soybean females and 5 different accessions of Glycine clandestina is approximately 40%. The wide cross pods can contain 1 to 3 seeds but generally 2 seeds are found in each F1 pod.

Embryo rescue: Our embryo rescue protocol involves direct shoot regeneration from embryos, rather than regeneration through embryogenesis, thus making plant recovery quicker (shoot recovery in approximately 2-3 months, compared to reported up to 1 year timeline). Our protocol does not include culture in the dark following transfer to germination medium. Our protocol does not require a transfer to rooting medium.

Harvested pods are collected and brought back to the lab to be sterilized. The pods are first rinsed with 70% EtOH for 2 to 3 minutes and then placed in 10% Clorox bleach for an additional 30 minutes on a platform shaker at approximately 130 RPM. Finally, the pods are rinsed multiple times with sterile water to remove any residual bleach. Embryo isolation can begin immediately following pod sterilization or pods can be stored at 4° C. for up to 24 hours prior to embryo isolation. The sterilized pods are next taken to a laminar flow hood where the embryos can be rescued. Individual pods are placed in a sterile petri dish and opened using a scalpel and forceps. An incision is made along the length of the wide cross pod away from the seed. The pod can then be easily opened to expose the seed. Alternatively, two pair of forceps can be used to separate the pod shell. Carefully remove the seed from the pod and place in a sterile petri dish under the dissection microscope. Very fine forceps are needed to isolate the embryo from the seed. With forceps in one hand, gently hold the side of the seed away from the embryo, with hilum facing up. Use another pair of forceps in the other hand to remove the seed coat from the side of the seed containing the embryo. Peel off the membrane surrounding the embryo and push the embryo up from tis bottom side. Embryos should be past the globular developmental stage and preferably past the early heart developmental stage (middle to late heart stage, cotyledon stage and early maturation stage embryos are desired). Isolated embryos are transferred to embryo rescue medium such as Soy ER1-1. Embryos can be treated to induce chromosome doubling at this time. (See below for chromosome doubling details.) Isolated embryos remain on embryo rescue medium for 21 to 30 days at 24° C. Embryos may remain in the dark for the entire incubation on ER1-1, may begin the incubation in the dark and complete it in the light, or may spend the entire incubation in the light. There is not a callus induction stage in this protocol. Shoots are developed directly from the embryos.

Chromosome doubling treatments: Either colchicine of trifluralin can be used to induce chromosome doubling. Ideally, late heart stage wide cross embryos (or larger) are chemically treated to induce chromosome doubling at any time from immediately following isolation up to 1 week post isolation. The doubling agent can be mixed in either solid or liquid medium and applied for several hours or up to a few days. Trifluralin is used at a concentration of 10-40 uM in either solid or liquid media. Additionally, colchicine is used at a concentration of 0.4-1 mg/ml in either solid or liquid media. Following the chemical treatment the embryos are transferred to fresh embryo rescue medium. Colchicine or trifluralin treatment can be done immediately following embryo rescue.

Shoot regeneration: Developing embryos are transferred from rescue medium to germination medium such as Soy ER GSMv2 for approximately 3 to 5 weeks in the light at 24° C. Alternatively, developing embryos may be transferred from rescue medium to elongation medium such as Soy El 0 No TCV for approximately 3 to 5 weeks in the light at 24° C. Developing shoots may be transferred from media plates to Phytocons containing either germination or elongation medium for further shoot development. Established shoots are moved to soil. Initial plant care is critical for survival of these shoots.

Ploidy Analysis: Ploidy analysis is conducted using a flow cytometer. Leaf tissue for ploidy analysis is collected from small shoots either in culture or after establishment in soil. Tissue is collected on dry ice and stored at –80° C. until analysis, or collected on wet ice and analyzed the same day. A sample size of 0.5 cm$^2$ is sufficient. Samples are prepared according to the instructions in the Sysmex kit. Each sample set contains an untreated F1 plant (not treated to induce chromosome doubling) as a control. The following are method notes: Wide crosses—Our wide cross success rate is significantly higher than that reported in the literature. No emasculation of female flowers is performed, which saves time and reduces risk of damage to the stigma.

The above examples clearly illustrate the advantages of the invention. Although the present invention has been described with reference to specific details of certain embodiments thereof, it is not intended that such details should be regarded as limitations upon the scope of the invention except as and to the extent that they are included in the accompanying claims.

Throughout this application, various patents, patent publications and non-patent publications are referenced. The disclosures of these patents, patent publications and non-patent publications in their entireties are incorporated by reference herein into this application in order to more fully describe the state of the art to which this invention pertains.

SEQUENCE LISTING (1 sequence)

SEQ ID NO: 1 - DNA, 5166731 bp, Glycine clandestina (residues 1-1,722,244 of 5,166,731)
  misc_feature (17726)..(17726): n is a, c, g, or t
  misc_feature (32023)..(32125): n is a, c, g, or t
  misc_feature (39492)..(39501): n is a, c, g, or t
  misc_feature (42725)..(42725): n is a, c, g, or t
  misc_feature (43747)..(44693): n is a, c, g, or t
  misc_feature (46850)..(47534): n is a, c, g, or t
  misc_feature (51356)..(51395): n is a, c, g, or t
  misc_feature (55018)..(56986): n is a, c, g, or t
  misc_feature (63435)..(63473): n is a, c, g, or t
  misc_feature (78686)..(78720): n is a, c, g, or t
  misc_feature (87711)..(87736): n is a, c, g, or t
  misc_feature (88800)..(88892): n is a, c, g, or t
  misc_feature (99662)..(100291): n is a, c, g, or t
  misc_feature (100725)..(100796): n is a, c, g, or t
  misc_feature (101514)..(101523): n is a, c, g, or t
  misc_feature (104149)..(104268): n is a, c, g, or t
  misc_feature (104561)..(104676): n is a, c, g, or t
  misc_feature (116599)..(116619): n is a, c, g, or t
  misc_feature (117799)..(117848): n is a, c, g, or t
  misc_feature (138741)..(138774): n is a, c, g, or t
  misc_feature (151441)..(152399): n is a, c, g, or t
  misc_feature (155921)..(156471): n is a, c, g, or t
  misc_feature (157927)..(158005): n is a, c, g, or t
  misc_feature (160012)..(160336): n is a, c, g, or t
  misc_feature (176635)..(176662): n is a, c, g, or t
  misc_feature (199150)..(199150): n is a, c, g, or t
  misc_feature (243771)..(243776): n is a, c, g, or t
  misc_feature (247513)..(247515): n is a, c, g, or t
  misc_feature (258810)..(258846): n is a, c, g, or t
  misc_feature (263629)..(263645): n is a, c, g, or t
  misc_feature (272231)..(272482): n is a, c, g, or t
  misc_feature (289741)..(289778): n is a, c, g, or t
  misc_feature (297584)..(297593): n is a, c, g, or t
  misc_feature (307524)..(307594): n is a, c, g, or t
  misc_feature (316377)..(316397): n is a, c, g, or t
  misc_feature (320205)..(320207): n is a, c, g, or t
  misc_feature (337342)..(337391): n is a, c, g, or t
  misc_feature (361388)..(361393): n is a, c, g, or t
  misc_feature (385450)..(385460): n is a, c, g, or t
  misc_feature (385779)..(385788): n is a, c, g, or t
  misc_feature (388072)..(388604): n is a, c, g, or t
  misc_feature (395035)..(395201): n is a, c, g, or t
  misc_feature (424413)..(424456): n is a, c, g, or t
  misc_feature (433347)..(434192): n is a, c, g, or t
  misc_feature (436994)..(437003): n is a, c, g, or t
  misc_feature (446264)..(446936): n is a, c, g, or t
  misc_feature (450900)..(451231): n is a, c, g, or t
  misc_feature (460033)..(460051): n is a, c, g, or t
  misc_feature (460621)..(460646): n is a, c, g, or t
  misc_feature (461120)..(461200): n is a, c, g, or t
  misc_feature (462328)..(462541): n is a, c, g, or t
  misc_feature (468079)..(468242): n is a, c, g, or t
  misc_feature (472105)..(472137): n is a, c, g, or t
  misc_feature (473423)..(473432): n is a, c, g, or t
  misc_feature (480790)..(480977): n is a, c, g, or t
  misc_feature (481389)..(481398): n is a, c, g, or t
  misc_feature (483211)..(483220): n is a, c, g, or t
  misc_feature (488427)..(488436): n is a, c, g, or t
  misc_feature (495704)..(496058): n is a, c, g, or t
  misc_feature (516998)..(517016): n is a, c, g, or t
  misc_feature (551129)..(551456): n is a, c, g, or t
  misc_feature (558768)..(558776): n is a, c, g, or t
  misc_feature (564377)..(564455): n is a, c, g, or t
  misc_feature (585847)..(585970): n is a, c, g, or t
  misc_feature (600682)..(600713): n is a, c, g, or t
  misc_feature (602366)..(602394): n is a, c, g, or t
  misc_feature (611830)..(611877): n is a, c, g, or t
  misc_feature (619204)..(619231): n is a, c, g, or t
  misc_feature (630263)..(631076): n is a, c, g, or t
  misc_feature (631492)..(631501): n is a, c, g, or t
  misc_feature (654684)..(654727): n is a, c, g, or t
  misc_feature (699736)..(700324): n is a, c, g, or t
  misc_feature (701989)..(702920): n is a, c, g, or t
  misc_feature (706430)..(706454): n is a, c, g, or t
  misc_feature (709146)..(709329): n is a, c, g, or t
  misc_feature (712225)..(712242): n is a, c, g, or t
  misc_feature (715243)..(715265): n is a, c, g, or t
  misc_feature (731428)..(732581): n is a, c, g, or t
  misc_feature (733219)..(733289): n is a, c, g, or t
  misc_feature (744250)..(744408): n is a, c, g, or t
  misc_feature (795817)..(795832): n is a, c, g, or t
  misc_feature (853224)..(853344): n is a, c, g, or t
  misc_feature (856035)..(856098): n is a, c, g, or t
  misc_feature (857137)..(857163): n is a, c, g, or t
  misc_feature (874275)..(874284): n is a, c, g, or t
  misc_feature (875085)..(875094): n is a, c, g, or t
  misc_feature (887116)..(887207): n is a, c, g, or t
  misc_feature (887426)..(887500): n is a, c, g, or t
  misc_feature (887676)..(887979): n is a, c, g, or t
  misc_feature (911098)..(911163): n is a, c, g, or t
  misc_feature (919760)..(919898): n is a, c, g, or t
  misc_feature (930727)..(930804): n is a, c, g, or t
  misc_feature (931085)..(931129): n is a, c, g, or t
  misc_feature (933645)..(933674): n is a, c, g, or t
  misc_feature (937513)..(937610): n is a, c, g, or t
  misc_feature (945613)..(945643): n is a, c, g, or t
  misc_feature (958592)..(958592): n is a, c, g, or t
  misc_feature (960133)..(960142): n is a, c, g, or t
  misc_feature (964349)..(964409): n is a, c, g, or t
  misc_feature (981912)..(981999): n is a, c, g, or t
  misc_feature (983839)..(983846): n is a, c, g, or t
  misc_feature (988539)..(988665): n is a, c, g, or t
  misc_feature (1001702)..(1001881): n is a, c, g, or t
  misc_feature (1004098)..(1004107): n is a, c, g, or t
  misc_feature (1006580)..(1007482): n is a, c, g, or t
  misc_feature (1009490)..(1009499): n is a, c, g, or t
  misc_feature (1012565)..(1012574): n is a, c, g, or t
  misc_feature (1020103)..(1020190): n is a, c, g, or t
  misc_feature (1025082)..(1025091): n is a, c, g, or t
  misc_feature (1026448)..(1026457): n is a, c, g, or t
  misc_feature (1031811)..(1033200): n is a, c, g, or t
  misc_feature (1034913)..(1034922): n is a, c, g, or t
  misc_feature (1040561)..(1040887): n is a, c, g, or t
  misc_feature (1055241)..(1055698): n is a, c, g, or t
  misc_feature (1057517)..(1057916): n is a, c, g, or t
  misc_feature (1068646)..(1068669): n is a, c, g, or t
  misc_feature (1077296)..(1077336): n is a, c, g, or t
  misc_feature (1086942)..(1087193): n is a, c, g, or t
  misc_feature (1092011)..(1092140): n is a, c, g, or t
  misc_feature (1119867)..(1119870): n is a, c, g, or t
  misc_feature (1121467)..(1121748): n is a, c, g, or t
  misc_feature (1127108)..(1127182): n is a, c, g, or t
  misc_feature (1127884)..(1127893): n is a, c, g, or t
  misc_feature (1132417)..(1133513): n is a, c, g, or t
  misc_feature (1134833)..(1134954): n is a, c, g, or t
  misc_feature (1147216)..(1147347): n is a, c, g, or t
  misc_feature (1171344)..(1171353): n is a, c, g, or t
  misc_feature (1184850)..(1185507): n is a, c, g, or t
  misc_feature (1206986)..(1207035): n is a, c, g, or t
  misc_feature (1209631)..(1209660): n is a, c, g, or t
  misc_feature (1218894)..(1218965): n is a, c, g, or t
  misc_feature (1228563)..(1228631): n is a, c, g, or t
  misc_feature (1265513)..(1265527): n is a, c, g, or t
  misc_feature (1328174)..(1328189): n is a, c, g, or t
  misc_feature (1337233)..(1337642): n is a, c, g, or t
  misc_feature (1338383)..(1338392): n is a, c, g, or t
  misc_feature (1363967)..(1363999): n is a, c, g, or t
  misc_feature (1371771)..(1371777): n is a, c, g, or t
  misc_feature (1378438)..(1378551): n is a, c, g, or t
  misc_feature (1389271)..(1389271): n is a, c, g, or t
  misc_feature (1390632)..(1391076): n is a, c, g, or t
  misc_feature (1391423)..(1391432): n is a, c, g, or t
  misc_feature (1399680)..(1399689): n is a, c, g, or t
  misc_feature (1400115)..(1400124): n is a, c, g, or t
  misc_feature (1406343)..(1406841): n is a, c, g, or t
  misc_feature (1411397)..(1412003): n is a, c, g, or t
  misc_feature (1415980)..(1416085): n is a, c, g, or t
  misc_feature (1424885)..(1425582): n is a, c, g, or t
  misc_feature (1444163)..(1446013): n is a, c, g, or t
  misc_feature (1467605)..(1467614): n is a, c, g, or t
  misc_feature (1471992)..(1472769): n is a, c, g, or t
  misc_feature (1479445)..(1481083): n is a, c, g, or t
  misc_feature (1483990)..(1484037): n is a, c, g, or t
  misc_feature (1498487)..(1498759): n is a, c, g, or t
  misc_feature (1501191)..(1501700): n is a, c, g, or t
  misc_feature (1520483)..(1520679): n is a, c, g, or t
  misc_feature (1535788)..(1535966): n is a, c, g, or t
  misc_feature (1544925)..(1545074): n is a, c, g, or t
  misc_feature (1546399)..(1546988): n is a, c, g, or t
  misc_feature (1547537)..(1547546): n is a, c, g, or t
  misc_feature (1547831)..(1547863): n is a, c, g, or t
  misc_feature (1562898)..(1562907): n is a, c, g, or t
  misc_feature (1563731)..(1564243): n is a, c, g, or t
  misc_feature (1585337)..(1586304): n is a, c, g, or t
  misc_feature (1622861)..(1622870): n is a, c, g, or t
  misc_feature (1627479)..(1627528): n is a, c, g, or t
  misc_feature (1627883)..(1627892): n is a, c, g, or t
  misc_feature (1636058)..(1636067): n is a, c, g, or t
  misc_feature (1636427)..(1636436): n is a, c, g, or t
  misc_feature (1652694)..(1652704): n is a, c, g, or t
  misc_feature (1666452)..(1666881): n is a, c, g, or t
  misc_feature (1674937)..(1674961): n is a, c, g, or t
  misc_feature (1691885)..(1692406): n is a, c, g, or t
  misc_feature (1708701)..(1709019): n is a, c, g, or t
  misc_feature (1709650)..(1709659): n is a, c, g, or t
  misc_feature (1714229)..(1714237): n is a, c, g, or t
  misc_feature (1723617)..(1723626): n is a, c, g, or t
  misc_feature (1723893)..(1723902): n is a, c, g, or t
  misc_feature (1724176)..(1724185): n is a, c, g, or t
  misc_feature (1725939)..(1728132): n is a, c, g, or t
  misc_feature (1738771)..(1738780): n is a, c, g, or t
  misc_feature (1739161)..(1739183): n is a, c, g, or t
  misc_feature (1740019)..(1740028): n is a, c, g, or t
  misc_feature (1750387)..(1750422): n is a, c, g, or t
  misc_feature (1756481)..(1756624): n is a, c, g, or t
  misc_feature (1757003)..(1757012): n is a, c, g, or t
  misc_feature (1768100)..(1768100): n is a, c, g, or t
  misc_feature (1774940)..(1774983): n is a, c, g, or t
  misc_feature (1787268)..(1787501): n is a, c, g, or t
  misc_feature (1787864)..(1787873): n is a, c, g, or t
  misc_feature (1788195)..(1788204): n is a, c, g, or t
  misc_feature (1795122)..(1795125): n is a, c, g, or t
  misc_feature (1795556)..(1795556): n is a, c, g, or t
  misc_feature (1798042)..(1798100): n is a, c, g, or t
  misc_feature (1798678)..(1799821): n is a, c, g, or t
  misc_feature (1823325)..(1823334): n is a, c, g, or t
  misc_feature (1823945)..(1823954): n is a, c, g, or t
  misc_feature (1846773)..(1846853): n is a, c, g, or t
  misc_feature (1887542)..(1888299): n is a, c, g, or t
  misc_feature (1900064)..(1900202): n is a, c, g, or t
  misc_feature (1901396)..(1901405): n is a, c, g, or t
  misc_feature (1903810)..(1903819): n is a, c, g, or t
  misc_feature (1904185)..(1904194): n is a, c, g, or t
  misc_feature (1941956)..(1941965): n is a, c, g, or t
  misc_feature (1951137)..(1951144): n is a, c, g, or t
  misc_feature (1957079)..(1957326): n is a, c, g, or t
  misc_feature (1961599)..(1963059): n is a, c, g, or t
  misc_feature (1964233)..(1965094): n is a, c, g, or t
  misc_feature (1977479)..(1977488): n is a, c, g, or t
  misc_feature (1993667)..(1993674): n is a, c, g, or t
  misc_feature (2009839)..(2009901): n is a, c, g, or t
  misc_feature (2010211)..(2010220): n is a, c, g, or t
  misc_feature (2011693)..(2011702): n is a, c, g, or t
  misc_feature (2016130)..(2016611): n is a, c, g, or t
  misc_feature (2033176)..(2033185): n is a, c, g, or t
  misc_feature (2055745)..(2055771): n is a, c, g, or t
  misc_feature (2058326)..(2059173): n is a, c, g, or t
  misc_feature (2073566)..(2073641): n is a, c, g, or t
  misc_feature (2073950)..(2074066): n is a, c, g, or t
  misc_feature (2074347)..(2074356): n is a, c, g, or t
  misc_feature (2078102)..(2078927): n is a, c, g, or t
  misc_feature (2085278)..(2085284): n is a, c, g, or t
  misc_feature (2093143)..(2093182): n is a, c, g, or t
  misc_feature (2110431)..(2110532): n is a, c, g, or t
  misc_feature (2116619)..(2117137): n is a, c, g, or t
  misc_feature (2136107)..(2136116): n is a, c, g, or t
  misc_feature (2136949)..(2136991): n is a, c, g, or t
  misc_feature (2144082)..(2144091): n is a, c, g, or t
  misc_feature (2148206)..(2148305): n is a, c, g, or t
  misc_feature (2148858)..(2149345): n is a, c, g, or t
  misc_feature (2154338)..(2154347): n is a, c, g, or t
  misc_feature (2155677)..(2155964): n is a, c, g, or t
  misc_feature (2171579)..(2171585): n is a, c, g, or t
  misc_feature (2175830)..(2175871): n is a, c, g, or t
  misc_feature (2176265)..(2176304): n is a, c, g, or t
  misc_feature (2178078)..(2178095): n is a, c, g, or t
  misc_feature (2187425)..(2187455): n is a, c, g, or t
  misc_feature (2189730)..(2189848): n is a, c, g, or t
  misc_feature (2192846)..(2192868): n is a, c, g, or t
  misc_feature (2212942)..(2213033): n is a, c, g, or t
  misc_feature (2235965)..(2236052): n is a, c, g, or t
  misc_feature (2243161)..(2243179): n is a, c, g, or t
  misc_feature (2263478)..(2263522): n is a, c, g, or t
  misc_feature (2267220)..(2267328): n is a, c, g, or t
  misc_feature (2276660)..(2276715): n is a, c, g, or t
  misc_feature (2287146)..(2287152): n is a, c, g, or t
  misc_feature (2345090)..(2345649): n is a, c, g, or t
  misc_feature (2357328)..(2357373): n is a, c, g, or t
  misc_feature (2376402)..(2376411): n is a, c, g, or t
  misc_feature (2381944)..(2381955): n is a, c, g, or t
  misc_feature (2390830)..(2391015): n is a, c, g, or t
  misc_feature (2391289)..(2391306): n is a, c, g, or t
  misc_feature (2410422)..(2410441): n is a, c, g, or t
  misc_feature (2419482)..(2419570): n is a, c, g, or t
  misc_feature (2422343)..(2422343): n is a, c, g, or t
  misc_feature (2435615)..(2435662): n is a, c, g, or t
  misc_feature (2456922)..(2457747): n is a, c, g, or t
  misc_feature (2474588)..(2475507): n is a, c, g, or t
  misc_feature (2506175)..(2506262): n is a, c, g, or t
  misc_feature (2517106)..(2517198): n is a, c, g, or t
  misc_feature (2518104)..(2518116): n is a, c, g, or t
  misc_feature (2528188)..(2528214): n is a, c, g, or t
  misc_feature (2531018)..(2531037): n is a, c, g, or t
  misc_feature (2562484)..(2563070): n is a, c, g, or t
  misc_feature (2568701)..(2569063): n is a, c, g, or t
  misc_feature (2570803)..(2570981): n is a, c, g, or t
  misc_feature (2581385)..(2581451): n is a, c, g, or t
  misc_feature (2590156)..(2590201): n is a, c, g, or t
  misc_feature (2596267)..(2598202): n is a, c, g, or t
  misc_feature (2600669)..(2602678): n is a, c, g, or t
  misc_feature (2607869)..(2607899): n is a, c, g, or t
  misc_feature (2610826)..(2610862): n is a, c, g, or t
  misc_feature (2614863)..(2614916): n is a, c, g, or t
  misc_feature (2650440)..(2650449): n is a, c, g, or t
  misc_feature (2651618)..(2651779): n is a, c, g, or t
  misc_feature (2721656)..(2722154): n is a, c, g, or t
  misc_feature (2726572)..(2726591): n is a, c, g, or t
  misc_feature (2756677)..(2756935): n is a, c, g, or t
  misc_feature (2792873)..(2792896): n is a, c, g, or t
  misc_feature (2807915)..(2808338): n is a, c, g, or t
  misc_feature (2826420)..(2826420): n is a, c, g, or t
  misc_feature (2846813)..(2847051): n is a, c, g, or t
  misc_feature (2867603)..(2867632): n is a, c, g, or t
  misc_feature (2893808)..(2893817): n is a, c, g, or t
  misc_feature (2932428)..(2932450): n is a, c, g, or t
  misc_feature (2932898)..(2932907): n is a, c, g, or t
  misc_feature (2938766)..(2939057): n is a, c, g, or t
  misc_feature (2941823)..(2942532): n is a, c, g, or t
  misc_feature (2950226)..(2950241): n is a, c, g, or t
  misc_feature (2953111)..(2953176): n is a, c, g, or t
  misc_feature (2958923)..(2958932): n is a, c, g, or t
  misc_feature (2960866)..(2961341): n is a, c, g, or t
  misc_feature (3012176)..(3012261): n is a, c, g, or t
  misc_feature (3018590)..(3018599): n is a, c, g, or t
  misc_feature (3019719)..(3019728): n is a, c, g, or t
  misc_feature (3025496)..(3025864): n is a, c, g, or t
  misc_feature (3036540)..(3036573): n is a, c, g, or t
  misc_feature (3065156)..(3065186): n is a, c, g, or t
  misc_feature (3071916)..(3071978): n is a, c, g, or t
  misc_feature (3095034)..(3095064): n is a, c, g, or t
  misc_feature (3104147)..(3104147): n is a, c, g, or t
  misc_feature (3120981)..(3121001): n is a, c, g, or t
  misc_feature (3142568)..(3142709): n is a, c, g, or t
  misc_feature (3148760)..(3148769): n is a, c, g, or t
  misc_feature (3149358)..(3149367): n is a, c, g, or t
  misc_feature (3149649)..(3149658): n is a, c, g, or t
  misc_feature (3155233)..(3155258): n is a, c, g, or t
  misc_feature (3156477)..(3156523): n is a, c, g, or t
  misc_feature (3159331)..(3159991): n is a, c, g, or t
  misc_feature (3169595)..(3169610): n is a, c, g, or t
  misc_feature (3183460)..(3183480): n is a, c, g, or t
  misc_feature (3200946)..(3201081): n is a, c, g, or t
  misc_feature (3210157)..(3210234): n is a, c, g, or t
  misc_feature (3217649)..(3217676): n is a, c, g, or t
  misc_feature (3220511)..(3220544): n is a, c, g, or t
  misc_feature (3224601)..(3224610): n is a, c, g, or t
  misc_feature (3229181)..(3229195): n is a, c, g, or t
  misc_feature (3235058)..(3235067): n is a, c, g, or t
  misc_feature (3239465)..(3239474): n is a, c, g, or t
  misc_feature (3244829)..(3244829): n is a, c, g, or t
  misc_feature (3252926)..(3252964): n is a, c, g, or t
  misc_feature (3290805)..(3291255): n is a, c, g, or t
  misc_feature (3308222)..(3308292): n is a, c, g, or t
  misc_feature (3313993)..(3314121): n is a, c, g, or t
  misc_feature (3325901)..(3325902): n is a, c, g, or t
  misc_feature (3335916)..(3335944): n is a, c, g, or t
  misc_feature (3342039)..(3342390): n is a, c, g, or t
  misc_feature (3352510)..(3353389): n is a, c, g, or t
  misc_feature (3355039)..(3355304): n is a, c, g, or t
  misc_feature (3370197)..(3370643): n is a, c, g, or t
  misc_feature (3393034)..(3393092): n is a, c, g, or t
  misc_feature (3401495)..(3401772): n is a, c, g, or t
  misc_feature (3412111)..(3412126): n is a, c, g, or t
  misc_feature (3419076)..(3419085): n is a, c, g, or t
  misc_feature (3419746)..(3419755): n is a, c, g, or t
  misc_feature (3420030)..(3420030): n is a, c, g, or t
  misc_feature (3429459)..(3429488): n is a, c, g, or t
  misc_feature (3431080)..(3431124): n is a, c, g, or t
  misc_feature (3431278)..(3431370): n is a, c, g, or t
  misc_feature (3432701)..(3433528): n is a, c, g, or t
  misc_feature (3436779)..(3436925): n is a, c, g, or t
  misc_feature (3471234)..(3471240): n is a, c, g, or t
  misc_feature (3488619)..(3489261): n is a, c, g, or t
  misc_feature (3515313)..(3515917): n is a, c, g, or t
  misc_feature (3522216)..(3522221): n is a, c, g, or t
  misc_feature (3530326)..(3530334): n is a, c, g, or t
  misc_feature (3535697)..(3535706): n is a, c, g, or t
  misc_feature (3537255)..(3537264): n is a, c, g, or t
  misc_feature (3538136)..(3538168): n is a, c, g, or t
  misc_feature (3539057)..(3539066): n is a, c, g, or t
  misc_feature (3540399)..(3540408): n is a, c, g, or t
  misc_feature (3543259)..(3543309): n is a, c, g, or t
  misc_feature (3553047)..(3553056): n is a, c, g, or t
  misc_feature (3553487)..(3553496): n is a, c, g, or t
  misc_feature (3581365)..(3581839): n is a, c, g, or t
  misc_feature (3588142)..(3588438): n is a, c, g, or t
  misc_feature (3588750)..(3588759): n is a, c, g, or t
  misc_feature (3591533)..(3594001): n is a, c, g, or t
  misc_feature (3596109)..(3599392): n is a, c, g, or t
  misc_feature (3606330)..(3606330): n is a, c, g, or t
  misc_feature (3644831)..(3645061): n is a, c, g, or t
  misc_feature (3645485)..(3645509): n is a, c, g, or t
  misc_feature (3654623)..(3654691): n is a, c, g, or t
  misc_feature (3656462)..(3657069): n is a, c, g, or t
  misc_feature (3657920)..(3657951): n is a, c, g, or t
  misc_feature (3671223)..(3671870): n is a, c, g, or t
  misc_feature (3674839)..(3675292): n is a, c, g, or t
  misc_feature (3684335)..(3684505): n is a, c, g, or t
  misc_feature (3703509)..(3703515): n is a, c, g, or t
  misc_feature (3724792)..(3724888): n is a, c, g, or t
  misc_feature (3727684)..(3728128): n is a, c, g, or t
  misc_feature (3742979)..(3743028): n is a, c, g, or t
  misc_feature (3754680)..(3755028): n is a, c, g, or t
  misc_feature (3755588)..(3755614): n is a, c, g, or t
  misc_feature (3771912)..(3772653): n is a, c, g, or t
  misc_feature (3786498)..(3786549): n is a, c, g, or t
  misc_feature (3794344)..(3794422): n is a, c, g, or t
  misc_feature (3798602)..(3798689): n is a, c, g, or t
  misc_feature (3801512)..(3801521): n is a, c, g, or t
  misc_feature (3802226)..(3802235): n is a, c, g, or t
  misc_feature (3810008)..(3810055): n is a, c, g, or t
  misc_feature (3814900)..(3814909): n is a, c, g, or t
  misc_feature (3823984)..(3823988): n is a, c, g, or t
  misc_feature (3829287)..(3829307): n is a, c, g, or t
  misc_feature (3839943)..(3839983): n is a, c, g, or t
  misc_feature (3842551)..(3842578): n is a, c, g, or t
  misc_feature (3854214)..(3854222): n is a, c, g, or t
  misc_feature (3887018)..(3887053): n is a, c, g, or t
  misc_feature (3891580)..(3891627): n is a, c, g, or t
  misc_feature (3900277)..(3900311): n is a, c, g, or t
  misc_feature (3913165)..(3913219): n is a, c, g, or t
  misc_feature (3919545)..(3919564): n is a, c, g, or t
  misc_feature (3926496)..(3926537): n is a, c, g, or t
  misc_feature (3941369)..(3941378): n is a, c, g, or t
  misc_feature (3942594)..(3942595): n is a, c, g, or t
  misc_feature (3945320)..(3945337): n is a, c, g, or t
  misc_feature (3949616)..(3949827): n is a, c, g, or t
  misc_feature (3963575)..(3963652): n is a, c, g, or t
  misc_feature (3981315)..(3981347): n is a, c, g, or t
  misc_feature (3986872)..(3987487): n is a, c, g, or t
  misc_feature (3998695)..(3998704): n is a, c, g, or t
  misc_feature (4014387)..(4014493): n is a, c, g, or t
  misc_feature (4019717)..(4019726): n is a, c, g, or t
  misc_feature (4023761)..(4023957): n is a, c, g, or t
  misc_feature (4024420)..(4024429): n is a, c, g, or t
  misc_feature (4027779)..(4027803): n is a, c, g, or t
  misc_feature (4029858)..(4029867): n is a, c, g, or t
  misc_feature (4030298)..(4030307): n is a, c, g, or t
  misc_feature (4040939)..(4041055): n is a, c, g, or t
  misc_feature (4044001)..(4044064): n is a, c, g, or t
  misc_feature (4102687)..(4103494): n is a, c, g, or t
  misc_feature (4104766)..(4104919): n is a, c, g, or t
  misc_feature (4120963)..(4120972): n is a, c, g, or t
  misc_feature (4140259)..(4143474): n is a, c, g, or t
  misc_feature (4144398)..(4144624): n is a, c, g, or t
  misc_feature (4146575)..(4147468): n is a, c, g, or t
  misc_feature (4148876)..(4148910): n is a, c, g, or t
  misc_feature (4152282)..(4152408): n is a, c, g, or t
  misc_feature (4154367)..(4154565): n is a, c, g, or t
  misc_feature (4161765)..(4162130): n is a, c, g, or t
  misc_feature (4162414)..(4162452): n is a, c, g, or t
  misc_feature (4193279)..(4193344): n is a, c, g, or t
  misc_feature (4205279)..(4205462): n is a, c, g, or t
  misc_feature (4206601)..(4206653): n is a, c, g, or t
  misc_feature (4211545)..(4211587): n is a, c, g, or t
  misc_feature (4230131)..(4230290): n is a, c, g, or t
  misc_feature (4252364)..(4252393): n is a, c, g, or t
  misc_feature (4257018)..(4257036): n is a, c, g, or t
  misc_feature (4258027)..(4258415): n is a, c, g, or t
  misc_feature (4258726)..(4258735): n is a, c, g, or t
  misc_feature (4265632)..(4265736): n is a, c, g, or t
  misc_feature (4275273)..(4275353): n is a, c, g, or t
  misc_feature (4318756)..(4318759): n is a, c, g, or t
  misc_feature (4334118)..(4334177): n is a, c, g, or t
  misc_feature (4334486)..(4334495): n is a, c, g, or t
  misc_feature (4337677)..(4337731): n is a, c, g, or t
  misc_feature (4358160)..(4358188): n is a, c, g, or t
  misc_feature (4360127)..(4360892): n is a, c, g, or t
  misc_feature (4376213)..(4376228): n is a, c, g, or t
  misc_feature (4384066)..(4384079): n is a, c, g, or t
  misc_feature (4411019)..(4411028): n is a, c, g, or t
  misc_feature (4463655)..(4463859): n is a, c, g, or t
  misc_feature (4472337)..(4472355): n is a, c, g, or t
  misc_feature (4493576)..(4493577): n is a, c, g, or t
  misc_feature (4498577)..(4498598): n is a, c, g, or t
  misc_feature (4513388)..(4513629): n is a, c, g, or t
  misc_feature (4514807)..(4514958): n is a, c, g, or t
  misc_feature (4525086)..(4525088): n is a, c, g, or t
  misc_feature (4548808)..(4548808): n is a, c, g, or t
  misc_feature (4550273)..(4550280): n is a, c, g, or t
  misc_feature (4570864)..(4571163): n is a, c, g, or t
  misc_feature (4572318)..(4572594): n is a, c, g, or t
  misc_feature (4573573)..(4573582): n is a, c, g, or t
  misc_feature (4575000)..(4575639): n is a, c, g, or t
  misc_feature (4576953)..(4577896): n is a, c, g, or t
  misc_feature (4580942)..(4582083): n is a, c, g, or t
  misc_feature (4626218)..(4626237): n is a, c, g, or t
  misc_feature (4646190)..(4646199): n is a, c, g, or t
  misc_feature (4646952)..(4646961): n is a, c, g, or t
  misc_feature (4650725)..(4651237): n is a, c, g, or t
  misc_feature (4652125)..(4652242): n is a, c, g, or t
  misc_feature (4656407)..(4656416): n is a, c, g, or t
  misc_feature (4656803)..(4656812): n is a, c, g, or t
  misc_feature (4662728)..(4662931): n is a, c, g, or t
  misc_feature (4665045)..(4666240): n is a, c, g, or t
  misc_feature (4690300)..(4690309): n is a, c, g, or t
  misc_feature (4690683)..(4690793): n is a, c, g, or t
  misc_feature (4691405)..(4691450): n is a, c, g, or t
  misc_feature (4700790)..(4700820): n is a, c, g, or t
  misc_feature (4711202)..(4711292): n is a, c, g, or t
  misc_feature (4712769)..(4712820): n is a, c, g, or t
  misc_feature (4722142)..(4722299): n is a, c, g, or t
  misc_feature (4732441)..(4732500): n is a, c, g, or t
  misc_feature (4737582)..(4737591): n is a, c, g, or t
  misc_feature (4744644)..(4744666): n is a, c, g, or t
  misc_feature (4756128)..(4756180): n is a, c, g, or t
  misc_feature (4757488)..(4757573): n is a, c, g, or t
  misc_feature (4761730)..(4761850): n is a, c, g, or t
  misc_feature (4762546)..(4762555): n is a, c, g, or t
  misc_feature (4767004)..(4767068): n is a, c, g, or t
  misc_feature (4773375)..(4773402): n is a, c, g, or t
  misc_feature (4780534)..(4780543): n is a, c, g, or t
  misc_feature (4787557)..(4787592): n is a, c, g, or t
  misc_feature (4798587)..(4798620): n is a, c, g, or t
  misc_feature (4804390)..(4804399): n is a, c, g, or t
  misc_feature (4809182)..(4809204): n is a, c, g, or t
  misc_feature (4814770)..(4815013): n is a, c, g, or t
  misc_feature (4828496)..(4828511): n is a, c, g, or t
  misc_feature (4863380)..(4863395): n is a, c, g, or t
  misc_feature (4876042)..(4876085): n is a, c, g, or t
  misc_feature (4892217)..(4892249): n is a, c, g, or t
  misc_feature (4911288)..(4911665): n is a, c, g, or t
  misc_feature (4934293)..(4934445): n is a, c, g, or t
  misc_feature (4955852)..(4955871): n is a, c, g, or t
  misc_feature (4962361)..(4964733): n is a, c, g, or t
  misc_feature (4972719)..(4973812): n is a, c, g, or t
  misc_feature (5043041)..(5043629): n is a, c, g, or t
  misc_feature (5054246)..(5056903): n is a, c, g, or t
  misc_feature (5089557)..(5089769): n is a, c, g, or t
  misc_feature (5103796)..(5103803): n is a, c, g, or t
  misc_feature (5115447)..(5115587): n is a, c, g, or t
  misc_feature (5162876)..(5163259): n is a, c, g, or t
atcggttttcccgataaccgatgttaaactagcgatgttaaaacctatttttttagtagtgagatcagtaagaatccatgtattattgtgctccaatgcgttaatcgcagcattcatggcttcaatccaataggatctttagaggcttcattgtatgacttaggttcaacttgttgtgggaaagataggataaaactatgatcagaaagagacagtctgttgtaggaaagaacacaattgagagggtaaaggctagtacctgtagagtgactagcaatagttgatgatgaatatgtgatgtgaaagtctttatattttcttggtctgtgtatctgtctcatggatcttctaggtgtatgagtggctttttgagaaatagaatgatcaggattagtaacattgggttcaacaacaatatgatcaatggatggttctgaaggagggtcatcaaactgatcaatagtatcattgaaagaagaagttggtacaggtaagaaggtgatgagatcaggtttatcctgagcagtgaatgggaagcaatccttatagaaaataacatttatggaaacagaaatagccatggttttaaggtcaagagtgatatatcctttggtgtttggcttgaaacccagaaaaacagaagtagcagctctttgatcaagtttctttttgttggcaattagattactagagaagcataaacaaccaaagactcttaaagaaccaatatcataagaagtcatatataggttttcatagggagttttattgccaagaaaaggagttcatatgcaatttacaagaacaatagagtgaattagagcataagaccaaaaaatagagggtaaatttgattgaaacaataaggatcgagctacatttaataaatgttggtgctttctctcaacaatcccattttgttggggagtttcaacacatcaagtttgatgtataatgccaaattcatcataaaattgtctcataatgaattatgatccattatcagatctaatcattttcacttttgtattaaattgtctttcaacagtgacaacaaagttctttaaatgagattgggtttcagtttctgaatgaataagaaaaatccaaacaaaccttgaatgatcatttactatagtaaggaaatatttatgatcatttaaagaagtcacattgcaaagaccacaaatatcaacatatatgagagcaaaaaggttggaagaataagaatcactgccaggaaatgacaactttttctattttgaatgatgacaagtatcacgtacaaattatttatcagatgtaagaagaggtatgattgctttaacaatagcaacctttcaaaagatgggtggactaatctaaaatgccacaagtctataggcactttattacatgaaaaagctgaaatactagaagaaacataagttgtaatagaagtgggattatactccttgtgaggcttgagaggaagtatgttgagcttataaagatcttccaccatatcaactataccaatcctttgcaggttttgcatatcctgaataaaacatggtgctttggatttctgtcgtgttagtgaataatgaaggtcatcgacgtggtggtgggtggtgccgatgaggaaaggagaagagatcagaatcaaattttggggaaaaaaactaccattaatggcaatacaactttatcatacaaaaatataaacatcaagcttgcccaacattaacgacgaagaagggaggttagtggtggtggtggtgggagtttccggcgagaccaaaatggaagagaagaacccacttgcatggaaggagattaaaaataaaaaataaaaaatagagtcaagacatataaatattaaattattattattattattattattattatatttaattaacctactaacatgttataacaagttaaaatcacttccataccgatgaacatgtatttttgaacctcactttagaattcacccttttctaagcttgtgtaatatctaaccacatattagaatccttcgaatatctcaaacgaaagaaggtaatataaaacatatatttttagaagagataaagataaaaaccatccgaagaccccactccctaaattgttctcaattatgtggatccatgaaactataatttgtcttacttcggggttagcgaaaaaaatatgcaacaagtaggtaaacacatactatatttaatttaagttctattagatttcataaagaagtaaatagaaaatccctttgaaaattattttattttaacacgaactgtgtgttttaaattagaaaaagtaacatgatgaaatttatatatgactgtgactccatcaataatatgtgtatgccacatgtatacatgcgtaaccaaacctaacatgatgtatttattatatgggcaatgctttgaacttttatccgtgccaatatatcctcccagtgagtgcttttcacctattgccttttaatacttttcttcataaaaattctgccaggtatagctagcctatggggacacaaactggacagaatgaccgacaggccggtgaagcaaactactgcctcaacctcatctccaattcacagttcacaaacacgacaccacaaaaataaaatcagtaaattttgtatatgttaattatatttttactaattttatactgtacaagtatatataaccaatgtaaaaacgatgtaataaaccctccaagtttaatacgaaattcctcacaccacataatatattaataaaataataaacggtctagatttttcacagattattggaagagtctttttttttttttaaatttacttttgatttatttttgcaatttcgttgccgcgttaccggtcatcgttaactcactgttgaccgcgttgggattgacggcaagactcaccatgtcaccgttggagacgtcgatgacgattccaatgtcagagtcaccgccattatcgacgccgcggtccgagttcacgcgcctcttcaacatcagcaattcatcaatcatatttgcagtatcttcagtcactgaaaaaacacgtggactcggagatcctgtgcgagtgactcagttcgacggaggagctgagttcggagtaaagcggcatgctccgcatggtgctgtcgaggaggttgatgccgatgttgagaatcccttgagggcggtcgaagggacgacgaatatggagggcgacgaagcggagcttgggtttgtggttgggagggaggaggttggcgacgaggtcggcgacggtgccgatgaggacatggcggagccaggcatgggagtagatctcgttccaggtgggattggtgtggccttcttggcacaaccagtttccagttgctgatgcatcatcaaattttaatccaatgcatcatcaaatttccagttgcgcaacacaggtggtggcatggggtacaaccccttcgcgattgccgtcgccgtgggagattgaggtggtgggtgggtggtaccggcgtggtggtggatggtgccggcatggtggtagttggtgcaggagagagaaaggaggagaagagcgccaaaggaaggagaaggagaataaaaaaaaattaaaatgattttattttacttattatattttttcttcctgttattaacttattattatctgtcaattttgagattcaccgatgcagtccaaaaatggaacttcatattagacgacttggccgtaataaacagaatttgaaaactatttgtgcttggcgatgattgagattgagggagtaatagctatcagtccaacccaacagacaaaaaagctagcgggcacatctgttctacagtgtactacattaattgttttgatattcattttcttccataaagcgatgcccagagaatcttggccccttaatatcaagttcgtaaataaatgcatgaccacactcttctccgaacatctcgaatgctgcaattgattatactagagttgggcccctacatagtatttaggaattttaataagttttttcccccttcattcttaaaaacttagaactgtttaaaatagtgatcaattgaattcggatacttttaaagtatgtagttcaaaaaaaatataattaaaataaaacattattaacggtgatgaattaagttgtttaataaaaactaattatgaaaaaaaactgtttaaaacagttatttatataaactataattattactgttactacaatatttactccaatgataaaagtcgatgagaattgcttcttaagttttgagaacccacgagaaattcacctgttcttatattccttataaatatcatccatttgtagcttcactcgtactcgcactcacactagcacgcttctgaattctttcactccacaaagtatatgcatctcaacacaaccatcttaaacttctcctcccaaagcccaacttgcaaaaattacataaattccttgcccaaaaaacttgatcagtgaacaaacatgggaagttccgtgtgcgtaaaagaagcatcagtgattacaccttctgagcccactccatcaagtgtgttggctctatcagctcttgattcacaactcttccttcgttttaccatagagtatctgttggtctacaaccctttcccaggcctggaccaggctgccaccacggcccgtttaaaagccgcattagcccgagcgctggttctttattacccttttgcgggccgggtcagacccaggcccgatgggccgggcctggaggtggtgtgcggagcccaaggcgcggtgttcatagaagcatccgctgaccgttacaatgttcacgacttcgagaaagcgcctaaaacagttacgcactggaggtcgctcttgtcgctccacgtggcagacgttctcaaaggattgccgccgctggttgttcagctgacgtggctccgcgacggcggcgccgcactcggcgtcgggatcaaccactgcatctgcgacgggatcggcagcgcggagtttctaaaccacttcgccgagttagccaacgagaaacgcgagttattattaggtctcaggcccatacaaaaacctgtctgggagcgtcaccttctgaacccgccgcgtgggaagcagacactggttgactcaacgagtcaccccgagttcaaccgagtcgctgatttatgcaacttcatgaacaaggtctcgacggggcttaaaccgacatcggtgaccttcgacaagaggagactcaacgagctgaagcgactcgcgcgttgcacgagtcaaccaggcgagtcggtgtgttacacgtcgttcgaggtgcttgcggcgcacgtgtggagaagctgggcgagagcaataaggtttccgccgaaccagaagctgaagctggcgttcagtgtaaacgtgcggaaccgagttaaaccgggtttgccggaggggtattatgggaacgcgtttgttttggggtgtgcggagacgagtgcaaaggagttggaggaaagagggatagggttcgtgtcgggtttggtgaagcaggcgaaggagagagtggggaacgagcacgtgaggggcgtgatggagttggtgtgggagagaaatgcgtgccctgacccggttggggtgttgatagtgtcgcagtggtctcggttagggttggagaagattgacgtgggtatggggaaggttgttcacgtgggacccgtgtgctgcgataggtactgtttgtttttgccggtgagggatgagtgtgtgagtgtcaaggtcatggtggctgtccccactcacgccgttgacaattaccagcttttcatgcgcgcgtcgcacctgtgacttgtgacgtaaatggtttttttctccctggaagaaccgaagatagcctgagaaaatttataataattataacttaggtattttgcttaattaatcgaatttaacttttcacggtaaatgtctgaaatgccccactctcacccattcccacacttctcacaagtgtgttttgtcctactttttgtagcttttgagttttgacccaaaatctaacttattaatcacggtagatcggtaattttcgtacactgcttggttagacaaaaatcatgaatttcttaaatgcaagttatttacgatgtgtatcaagttttacatgtgtgtcaagttttttttattaaagaattgattatgagtttaaaattaattttagatatttttttatatttgattttatgtggtggaagaagacttataattaattttggattgaatcaacttttactagtttttttttattgaattcaaaattttgtattaatttttaattttaacttaattttatgataaaaacatttatacataaattatattattttaaaatcaattttattaaaaattaattttgacaatctacattcaaatacacagagaattgggatcgaatttagattaaatgcgctgaatggttatggttgaggttttacgaataagaatcgagattggtagtgtgtttgcattttgcaaaatgatgaaatgcccaccatggcctatctcacatggtggaccatgaggcgctgtggcaacgaaccaagtggcacaagctctatcgatcatgtagtacagggaggaacatgatctcccattttctaatgatgtaatgcaaggatgcgcctttagtagctttcaatgcaatcactacgacactacttctctatctatatgatagagtcttaataattagtaacgaaattaaggataatcaaattttatttacatacagtttatggataacagaatgcaatctgtgcctacgctatattatactatgtaattatgtatagcataattttcttagtctagctaacatctgtaattttagtcaatgtatcctcttgttacttagttgactaaatctattatgtgttcacgagtgatgagtttaattgaagcatctgaagtaatttgaaacattcagataacatactacaaacgttgcaataaaaaataaaataaaataaaggaatgtagatagaagtgagaagctatcaatttggcattttagcatttaataattttagacttattagtgatcacgtaacaataaaagataaagattgtgtctgatactattcttcctgcaatattaatatatgtttgacatgcatgtgatggagaaatttaaaatttagtagcacagaacgttatgcatgctcacgataaacttctgtcaattgggcaccataagtttattttggttcttggccttgctggcttattctggttgttcagttaccaaaccatgtttttgtgggtaggcaccccttgacccttgtgccatcttaatatatgattctttttttggctgatgaaaaaaaaaacttctgtccatttttaagagaatgaagtgtatatttataagaactctagagaatgtatatatcatttttggaagagaatatgcattgacaattgttgtactttaattgaagagtgattcctataaatcatgttgtgttaaacttcctcagaaacaacatcattggcattcgttttgatgggttattgacttttcaaaatttatgattgaactttgacggctatagtaattttaactgtctatcataaagaataatacttgtaataagtaccaaattgaatattaaaataatataaataattaatatattagaattaagattaaattatttatataatatttgaatttgatttttaacaaaaagtagtcagaattacattctgacaatgaatcagagcgttaacacagaaaattgacaaggagaattgactctctcgttattaaagtatgctagtagcagtatcttgtagaaatttactccttaaaggcccaaatttctcctgcagcgcgcataattttcagcaaccatgcacgggattgagaactgtgataactgttgacaatatttcaaaggttagattttccggatctgctgttccatgacaagaatctttgacctagaaaggctgacgagggagccaaccgaaggggcattacgctaacttatgctgattaaacggcacattttgagggaaccataaaatagtaagttgattttgctattacaagacaattttagtattttggccaagaatatcctttttccctctgcctaattttttcaatcatctaaaattattgatatccaaatactattattaaacatttatgcaatattggaatgagtgaaatgagatgatattaaacataataaaattcgctaggtagataggaatctattaaaataaaaactccattccgtgttatttaaatattttatgatggattggaagaaagtttttatttcatttttagtactgaatagaatgaaataaattagaattttttttatacatgatcagtataattttatttacactatcagttaattataaattattttaaatataatttttaaaataattattataaaaattaacaatatgtaattatatgataatctataagctttaaatatcccttctttgatccaatgttaccccaaacatacccaaagttttaaatatcccttctttgatcccaaattatcattcaatgaatcagtttctttctcataactaaacttcctgctgaatcgaacatataaagatgagtaaatcgacaagaaaactcaaaaaataattgaaatcagcaacatgatatagaaaagtaaaaaatctaaaaaatatatataccacttaacaggaaaactaatacttaattaattataacttatcaccatggctttcatgggcttttgcttagaaaatgagaaaaaaccaaaacagaaatgccataatgaatggaaactaagaagttcagtaacgatatcactttccgtatttgcaacatatattggtctatttgcaacaatatatattgggctattcatgggttgcatcatatagattggactatcgtaatgatttgttgggctaaaccttcgtgcacttttcatttcattctaaaaagttcgttttaaaattcataatcagctaaataatttaggtcctctaatttatttttaatgatcaattaggtcttctaataattaaattattcaaaacggtttaatttagttctttttgtcaattaaatgttaacgttaacattacaatctaatgtgtcaaatgatgtggcatttttttaatagatgatctgtcgacaatgcttatatttaatcagtttaaataattaaaggatctaattgaatcatttaataattaaagaatctaattaaacattgaaaataaattagaacacctaaacaataatttaatcttcataattatattttagaatgagctttttgaaatacaatggtaagtataagagtaatagtgtgagtgcaggaaacaacagttaccaactcaagtaggatttgaacactaaatcatttcattaccttgaaagaaatcgtgaacgggtgattgtcttttgcaactttttttctcaaaacaccctctatcactttttatttttatattccaaattctgaaatgtataaaataatttaggttaattaagtttttagtcttttaacttttttagattctaatttgtaatccctcaattttttttgataacttttagttctttattaattcttggtccttcaaattttttttgcccatttttagtcccttaatgtaaaaattaatttctagaatgtaaaaaaaaatgtattaaagaaaaacgggtgcgaaaagaagccccagtgatataaatggattgtctttttcatttaggaaattgattgagctgggttcagagtttctgatgtttcttatcgggccgtttgatagcactgtataagattgaaaattgacatttacatcacatattatgttaagttcacaccccacgattgtgtattttctttttatacaaaaatacctgacaggtaatttttttaggagaaacagaaatactttttgttaagacaaatacagaacgaaaacatattttcatttcatcataaggtgtgcaagcataacatataaaatggaaacacataaattttctatttcttttattgaatttagcttctatatattgtaagtattaaactttttatataattaatttatcagaaattatgataagtaaagtatttaagataattattgttaaaattaataagataatcatattcaaatttacatacactatatactcctttcatttcccatgaatcacatgtatccttacataaaaaaaaatcccaggactacgtactacatacactatctttaatcttggacaatagtcgacttaattattcctaagatttgataggattaacatagtaactgagatgtaatgcactaatgcatggttgcttgttgccctttcagtacgtatgggtggacatgaattgaatttttaatccatagtcaatctatatttatttaaatgaattgaattttaaatttatatccatattttttaaaataatttgaattcaagatccaattcatttaagtggatatagatttgatcatatccaatctatatccacttaaatgttataaggatttatttttacaaattataataattaaacactaaaaagtgaaaacttagtacttgttcatttaaaatcaattttccaccgaatttgatcgagactattttcgatcaatcatggttaagatattttcagcctatctcaacagggcaatttcggctaactgatagtcaaaacatttttagaccgacatcaaccaatactattttttggctggcgttggtcaatgcattttcggtggacatcgatcaaggatgttttgggtcaatcttaggtaagattattttttggttggggttagctatgatttttagttaatgtttatcggtgatatattttggccgacatcgactatgggtttttcgatcagcgtcaaccatgactattttttgactgacatttgttaaggtttttgtgggcaacatcggtaaagtgtttttgaccgatgtcggttgttgatatttttttgccaacatcaaccagaattattttttggtcaacattggctatgttattttgctgatgctggttgaaactatttttttgttggcgtcaactagggtttattggccaacattggccatgactatttcttttggtcgatgttgactggagattttttttttgttgacatcaactaggattttttcgatgaacttttcaattgggggaacattttggccgatgttagctagttttttttttccgatgtgggtcaatgatgtttttttgccaatgtcggccaaaaatgacctagccaaagttggaaaaaaatagtctcgtttgatatcgaccaaaaaataattccgacaaacatcaacaaaaaaactttagctaaagtcgaccaaaacatagtttcgattgttatcggccaaaaaaactttggatgacattggcaaacaaatagtccagaccaactttggcagaaaatcgttaccgacattaatcgaaaaaaagtctcaatcgatgatggcttaaaaacatcatgagttgacgtcggtcaaaattactctagatgacatcgaccaaaaaataactcctatcgaagttggccaaaaaaacttagccatcaccgtccaaaaaatattattagatttaaaaatctaaataaatatataatccatatccaattaatttaattggatttaaaattaaaaaattggatttagatatgaaattagaccatttaaatggattaaattgagttaaatatgaattaattttatatatttgaatttttttgacagtgcttcgatgcttgtatattcatctgtaccatgcgatggtatataaatgaaacttgattgatcgaaaatttaaccttatgttgaacctttccaatgtttgtaattcgctcaatcagacctgttaagggatgtcaagttagaagtcaaattatgtattgatctgaaatggtttgcaaaattttattttctagatttttttcatacgtgggatgaagatcaactgggaatatttatattcttttcaatcatactataatgctattagactgagtctgaggctaggtagtgttggacaacttctttttagtttttagtttaaacaaaatcctaaaaagtttatgaagaacaaaagtaattttgtaatataaagaaaatataaaaattaagctttacacgaagtcatgaactaattttattagtagtttcccgtgtcattgttccaagactcaataatatattatccaattatatatattttaaatcacatatatgttttacgaaaattaatcctaatctaggaggatgtaattactataaataattgattttccttttatgtatttaacagagttgttgcatgtattcaaaaatagaaagattgccaattaagcaataatggggactccatctccgcatcaagtcaaacaggttcagattccaatttataaagggcgagatgaaaaaatggaacttgacccaacccatcccatgctcccacatccccaagttagggaaaatacgatcaaagtaattttttcttgtcagactttggacaggatccgacggatgtccacatgtttaatttttattgccacgtgtaaacaataacattgatccacttgttctgtagtatcccaaaatattaaaattactaaatagttttaacctgaatttaaaaaattctaattctaatttgaaagtaattttaattaagatccacaaaagtcaagataaacgtcaccttaatgtcggcaatagcttattaatgtcgacaatttggggacagatgatttgaatccatcaacaacgaccttaacgatgaaataaattaatataaggcaagttcatccatattggtttgtggtgtattaatgtatgagacggttaacgtaacttgaataaatgtcaagcgttatcttttgggtcatggcttgtaaggaactacactgttgtgccatatacggcaaagaaaaaactgttgaagctttacggtattggcattagtcttcggattcctatgacatgacacggttaagcttatatatggaccatggtggtggggttggtgcgtgactctgaaaatcacaacgggtgctccgtgcgttgcaataaacagtacggttaattagacccacttcagagggatttgcaagaatcaaagtagctatagtagtgttgctgtctctatactaaatggtgtctcacacatgttggtggtgccattcaatactcaggttcatctggtccactgtctacatcacaaataggttatctgaattcacaatcagggtctttgttctttgttctttttcttttttttattaatattttttttgtttttgatggtggtggtggtgtctttactaagcaaacaacaccggaaagagataatcagaagaacatatatacatgcgtttggaaagcagagtttctttttggtcactgggtgatcaagagaagcatcatcatccgtgaaaatcctattataattattacataaatgaaattcaaaacacaaagaaaatcatcatttttcctataataatagcatggagaaaacttagctattgatccctttaggagtgtttttggtgttatttttcaatcagaattgaaattttacctcaataattttgcatcatgatttaatagaaacctttattacatgaattactaagattgaaattccaattctgacagaagaacaacaccgaaagcagccgtgcaacagtatatctaatttttgtcctagtagcataggaattatgaagctaaaagatttcaatgaagaccaattcattctagaaggtgcttgattatttatttgcatacacaacacagtcgctgcttttgatgattgatcagaaaattcagaacaattacaacgaaagagagggggggtgggtcataactaacaacatatctcaaaatatatatgggatttgaatgaaatcatccaccgtttcatgtctggtcaatgatgattgagacgaagaggtgtgacagaagttgtcattattgaaattatcagcacaagtgaaaaaatcagggaagggtggcaaactaacatggccattaatcaaggcatcagaagcggtggttgtagcagtagcagtagtagcagcagcagcataacgagcaagacggtccttagcaatggcaaggtcatgttgaagctccaccatcttcctttgcagcagagctatggcaccaatgcatccataaaccgggtcccgaagccgtgcttccgcctcataagcaagcgaattcaccgtgtcctctctctgttcctcaggaacctcaacgaggatcttgctcacattgcttgccccgaacaccttgtgcaccttggcgaatttcttgcactcgttagagcgaaagtaaggtgcaaatatgcaattgggtatgcaccttctcttcaagaacttgcaagctgcacaagaagagcttgaacgtggctcataacccttcatggctctttcaattctctcaattttcactttactatagtgtttgcacttataagtatatggttctctcgataggtatcttgctcaatcgctatttaagggctaccacgtttccttgcctatgctcagctaggtagcaggttctggacttgcatgggtcaatgctgtctttttactgcatttattttatgttatttgcttttgataaaaaaatattatttaggttttctctagctagtatagtagtatatttaatttgccatctataccattcattcaaattgggagtgcaaaagtaggtccaaataattgattcatgtggacaatgggtggtatgagttggtagttttcaagtaagatatgatagttcatgaataaagatggccggggatattttgattgattgaagaaaagaaatattctcaataaaagcaaaattatcccttggcagtgagaggtatggtcactagaaggaaaccaataagatcgaattgagtactttagatgtagttggaatcttcaggtacagcatagtggagccaaaaataaagctagtgaattgttgtttttatgctttctatatcattcgatatttcgttttttccgttattatttttgcaattctagttgctttctaacaaactgaaacgggaagtttaaggtgaagaagctataggcctatagcacatggaaacaaactgagtgcgtgtcaaattttaaccacattaaactaaacatcttctggttggtcttgcatagtaacctaacatgggtttccttttcctttttcttttttttctaaaagaagaaacacaagggtgtgactgtgttaggggtgtattatttttttatataaaataaaccaaattagttacatattcttgctaattctatgggaattaaatatacaccatgcacatgcacatgaaaaatgtttttatgaaggaatttaaataaatatataaaaagaggctattctataaacatatataaaagcaaaaccaggagctaatcatgaactgattgatttccattcggcaagcaataagcccaaacctgactttattattagattaataattattcgatcaaggaatccataagattcaaaaattcaacttcataataaagattcaagagaaaaaatagagtgaccatttatgagggatccatacatgtattaacttttcattcagcctaactacatgaatccggatacactcctctcagtaacctagtaatcagactattacattcaatagattatctttaagtttatttattcaaatattattgataatattacaactatatttcaaataatatgtacttaattatatacaaaatacatattatctataaggtatgaattatctataatctaattatttataacatataattattcattagtctttatttacgtgttaattatttacaaagatttaaggcccaagcttatgttataaatacaggtttcatttaacatttcattcatattcatttacacccaaatcaaccgaatacaaagttatttacttatctactcatactcaattatacttttctctttataattgatgtatttatttgagaataagaatcgtttcctttgttttacaaattctcattcttaataaggttgactcatccaacatgcatagtctgaaatccatctgaaccacatttatctttatacataatactttcggtaagaaaaaaacatgatatactataaatttgatattgttttatctttaggaggccacctcacgctgaaattgatgtttacacagataaggattaaaacattaaaatattttatcattataactagataaagaagacattaaactgtattaagaaattccatattcgaaggttcaacctagtcgtagatgtcctataacgactttctatcattgcatattactgtgggggtgcaactgtaaagatttcctatctcattatggaatctaatataataattgtagattgcattgttaggtggactgatcatagcccagaatttggagggacttgcataatttggtgaaaccaatctcttggttctcagaccgtattttgacacaatttaaaattattaaaattagagtttatattttatgcattattaggataaaataattacgatgttaaccaataaaaatttatgaaaagtataaattttaaggtgattgttgttaaagtcaaaaaatttattgaacatattaattgatgattgaatgacaatattttttttttatattgttaggtcatctctaatgttgttatttactagagttattttcaagttaagttgtttaatgtgattgttttagcataataacaaaaaaaaaattatcacaagataatatatatttttctaaataagttttgcatataataatcatagggttagattttagtcctcattataatatttaaaattttgtaaattagaaggaaagatgagtaaagtgtttatcaagtcaattaatttgaacttataaacaaattaacttaatcaaacatgactaaattttttgttaaaggaaggagtcaaagattttaagaataaagtttgataaacataagaaaaacttaaatcaatagattatgaacaaaccacataaacaaaacttgatatcataatttaatccaaaattttaagatttaaatttatggatcttattttcacttatgtgatattcaatcttcttattcttatttaatgtgagactcatctttatactcattctctaacattttagttaaacatgattaatttatatttcatttaaccttaaatcaagtcaattcatgaagattctgagggaaatcttgtaagctgtatcacatactgtttagaaagaaagaagggaaaaaaagataatgaaggtaactttgtttttgtgatctttttgattaggtgtgggagtgggacatgataaaatggggaagataagtgtcacctcaaactcaaagtcatggtggtagagaggggaaagggatggaagatgataatgcacccaacctccaatttctaagaccccaacccaagagcccacttgtttaatgcgcgtcgttttcccttaaaacaaacaatggacaatagggtgtggggggaaggaaccttccatgcaagccgttggatcaagatcgacggtgggtaatactcacgcgcaggagtggatcgcggaactacggataatagcttccgcaaaatgggccggnctcttttttttttttttttgttcattttaatgcacattaggagcgaaaacaaatatgaattcatattttctgataccctgtaccatgctggacctagcttgactcggtcaaaagcttgtgagcggcaatgtatcatagtcccctctctattatttatatttgaggttcatttctaaattattattctcttttttaaagtaataaaattatataaacattctcaaatattataacgagtagtcctctaagtatttaaaaattatcaatttaaaacatatcaactcaaggattaaaatgatggatatttaatacttgaaggattatgtatataattttattactctaggaactaaataagagagagggtaatactaaattagttgtttattccttatttttctttggtatatatgtatatatatatatgtgtgtgtttttttattatagaaaatcttgtttaaattatataagattattataaataatatattttttaaaagatttaatgtaactacatatacaagactttaatataagataactaattaataaaaaaaacaacactattaatcgacacgttagatgttaggcggtgtctctattattcattttgttttattgaaattgaataattcttttttaattataaaaaaaaaggagatcaatctttctttaaagagaaatcagaaagtgaaggaaaaacataacagccaaagacgaggtagggggtggtactaacccagacaaattaccgtttactataggtaggctgagtatctctcttgctacaaaaataatacagtgttgtgctgcttcttggttcagaaatcagaagtgctactactcgataaagtgaaaccagaaaaagtaaaaccaaatatgatgaactgattgactgcttaccaaatcaatgatatgcacaaactatatcttgcgtctttttttttttttctttagttaggaaagtgactgtcacacagtagtggagacattgtgcattgtttgaaattttcagtatagacataatatttaggtcttttcgttttgaaattagaaaaataattatcgtatttgtaataaaaaaaatatacgttttaatatatcttttcttctatatttttttttttgaaactgaactgtatctaattttaccttaatgttaaactgaatggtctcttattaaattaagaaaacacgaggaatttagttatgcgatatgtttggagcttctttaaaaaaataaaaaatgctgaaaggtatttttgccttttttgttgcaatgaaactatgaaaagttgatgagagatatgagaagaatgaaaagtgaaaacaggatgaagctattgggaatcattgagaattgaagtgaagtcaaaagcttgtaaaaggtgggtggtattgacattgttacttttagttcggctgactatggatgtggatcgaggcacctaggctttgaagttaaagtagccaatcctagtcaattgtaagccattggatactgaaatttcaaaggtaggcttgatccaaggaagttataggctaagacaagataacgaggaagcaattgttttatgcacccatttttgcttgatgaactcccaaaatttaatataaccccatcttacccttctctcctctcccattgcctactttcttatcctttccatcttcctcttgaccgcttcgtgccttcttgctttcgttactaatcccctatcccgcacctctacattgttggcacatccttctcatcctttagattaggattcagagttatgatttcataattttggattgagtattctagaatgtattagtattctagaatactcaatccttaatacagacaaatgtattctaggagttagactcacttaccttagtgaccatttatggtctccctatttcgactttgaattactttatcattcttcatcttgtcaacgagttctttataaatgatctttgatatgggcagtgacatcacttggactcaatgtcattcgtgtaaggattattgctataagcaatctgatccaatatttaatccactaaattcttcaacatatatgcaaaaaacttagaaatactctaggaggtaaacatttaatttttaaaacaacaagtaagcttaatttatttcatttcccatggagcaagctacgatagtctcgatgacataagtccatgcgagtatgaagtccattatggcgacaaatcctttatcaagggcttctatagcagcgatcgcctcaccctttactttgatcccatttatccctccaacaccattgacaacttctacttcgactgtggtgaaaataagagaggactctttgtccacattgctgactttttttacgttggtcgcgacaacctctcctttgtggatcatacctcgtcaaagtacaaggaaacattctcctactgcatccccaacaatgactatgtcggctttgtcacctttggcctcgacgttgcccgtgatgatgactcgaatacacccttttaatcaccgtcatcgcccgcctttcattttatggcctcgacatcaccatcgatggtcatatagtccttagccttgcctttcacgaaatcgagcacgatggattcatcatcgactttggcactgtgactacctgactctctcagacaatctatgccatgctctagttggcatactaacaatgcatgtccaattaccccaccgtcgacaagtatgacataatggatggaaagaacatggttggtaggagagaccccactaaaggtgatgagtcaggttctcgacggagattagtcatcagtaaaactggtggatactctgcaccaatatcatggtgataaaaaaaaaagatgacaccacttataacagtttagactatttggaaaaaacacctaatgcaacaatttcctccatattcttcttctattagatatactaattaaacctttaaaaaatacttttactaacatccacttcaacagttccacttaactacacataaaaaaattgacaattattagttataataaatagaatacggtacaactgataaataattgattttatttaaaacattaatacatatttactcctatataaaaacttttttaatgatttttatgtttgaaaaaaaattaggtcaactatatttcattttttctatgacccatatattgccaaatgaattaaaaaataaaataagattatacacacacacacacacacacatatatatatatatatatgtatatatatataatcatgatcaaactaaataagaaaaaacataataattaacgtttttattatttcagaacaagatgttttcaatttatgcaataaacgtttacacctttaaccaaactctgttcatccacacactacgatgaaagcatattctattacccgaaatatcatgcacaatctcaaggctttttctagacattcccaacatcaacatcaacaccaacaccaacatcaacaaaacctttaacccaaactaattggggtcgatggtagataaaccaaaatacgctaatttcttgtcaaattgtttgggagcaaatgccaagcaatacctcgtctgattgacttggatgaatgtcacattctacaataggtccatcatgacaccaaaaaacacaaacaccatttgggaattggaatttaaatccgctaagatcataatatgtgttcagtatttcgtgctcgcaagcagttgggtagttggacatgcattgtcagtacgtcgattggagcatggcatagatggtttgggggagtcaggtgattgttggatatagggggagtaacaagaagatgaagcttgtgccttagaagaaagttttgagtttttcacatgccttgaagattgtaattcaaattaagtgtatgagagaccaatcttttgatccttgcattgcatgcacataatcattaacatgcttacatgttttcattaaagtatcaaaactattcatgtatttaaaagaaatctataagtaatgactaatgtttttggaaaaatgtaatcttattgctttaatcgattacacatcagtttaatcgattatttgcttcgttttaaatctggaaaaaccttgaagaacatattaatcaattacataactcttgtaatcgattacatagtaaaaacaaaagcatgcctcactgctttaatcgattactgcaaattgtaatcgattacacaaagcttgccttacaatgaacttcactgctttaaccgattactacaaatcgtaatcgattacacaaagcttgctttacaataaaattcactgctttaatcgattacagctcggttaatcgattattctgtttgttgtaaaacccaggatgaggctttgaacactttaatcgattaagtgacaaattaattgattatataagtcattttaattgattatttggcgtgttgtaatcaattacagtctgttacaaaaagctattataaataggataaaggcttgtccggtttactaacttgaatacttcgaattttctgaatatacacaagtcttctcaaagttagaaagtaattttctaggttaactaagatcttgtcccactctttaatcttcatgggtattgaatgatttcttgggcaagagttttttaagaagttttggagagcatgttctgaaatccttttctgcaattcaactctgattggtaaaccacatgcattcatattcattggatcatcaagttgtttctctccattatctctggttgtaaattcgtttttgtattttttgttatttgaagttattgtaaagagttctttgaagcttgtgctagagtaggattctctagggaagaacatagtagtgttctctggttctagatcactaagagtctaatagagtttttagatttcttttctttatctagggttgataaagagtgattgttgtaaagcttgtaagaactaaaatttgtaatagtgaaactctaatctagtgttgattagaagaaactggatgtagcttctcttgagaagtgaaccagtataaattcttgtgttgattttcttttccttaatttctactagtcatcttgttcatttgttcttagtattattatcattactcaactagtcctgttttgagcaattgatttcttgagttgaatggtttgattgattagagacatttttggtttgaaagtgattaagatcttttaactctgattttataaataaattttaaaaagccaagtttaaaccaattcactcccctcttggttattgtgggtattcttattgttttcagtgaccacaatgttagagtcagtgattgagttgttatgctttgtttggtagaagtagatgccagggagtatatcaccgtcgatgtcaagattgtaaaatgagagaccatcgggagaggtcattaaaggggtgtagttgactccatcatcgagggaagcatcagggtcgggactaaaggtgatgtagccgacatagtcattgtaggggatgcagtaggagaaggtctcattgtactttgtgaaggcttgagacacaaaagagaggtccccgtgaccgaggcaaaaaatgccaacaaaatgcagccaaagtgtcctttgttattttcgtcgcagtcgaagtagaagtcgactacaatttcaggggcaaaggtggggtcgaagtaaagggtgaggcaatcgctaccatataagtcctcgataaaggatcgatcaccattatgaacttggtacttgcatggacttatgtcatcaaaataagtgttccctattgcatgttaaaatgaagtcaattaagcagcttacccttttgaaatatgtgttagaaaattaatgtttatctcctggttggtttttgagtttttttgcacatctcactgaagcaatgagtaatgaagaatcatgagatggattaaatattagatcagattgcttatagcaataatccttacatggctcacattgggtccaggtgatatcacttcccatgtcaaataccatttgtaaagaactcattgacatgccaagacaaataacgagaatatagttcagagttgaaatagggagaccaagaatgataggtaatgtacatgaatcatatttcttcaattcggactgaatgtgcttcactcattcaaggtccttgatcaaaagtacattgtcattattacacttgacatgggagcatgacccatccatatggaccaaatgttgtttttcttctgatacttgaagtttaatagtaatagttagaaatgataataaaaataataatacatatactagtatttatttaagacatggtcgtgtagaccattaggcaattgaggcaatgacctaaggtcttcaatttttaaggcctcaagttttttttttcggtttttaataaataaattattattaatttaaattattaggtgataaattttgttataatatgatgtgttatttgctattattttaataattaagatttcaaatcttaagatatttagttgtaaatttattattatttaaaaatttagaaaattattttacatctattttggattccatctctttctcaataaaaatgttattgaaattaatatatagtttaaatttaatgatgaatctatgattgatagagatatatgtgcacgtgcgtgcatgttcatgtgcatgtgcgtgttttcattttgttttttaaaaacaaagatattaagtgaatgacataaaaaagtaatatactctattagtagtattaaattatattaaaagattttttttttcaaaatcttacatttttaaaaaatattattgataatacttctaactattgttattgctgaatttttattttttaaaaaaaactaaaattattcaaatcttatataagattaatgtatttttcactttatacattaagagtgaaatactttaattattaaaatatggtaaataattttgtagttgacaaaaaaattaaaaactaataaattataccaaattaatatttaaatgtgaattttgtcttaggcttcacaatttatagacacaaccctaattgaagataagacttactaaattcaatcattttcaaccggagacatttgcaagtaagtgaaacatagaagaagtggaaagacaagaagtttaaagacaggaagaaaacaaaaattgtacaagaatacatctcttctccaatatcgcacacatatgttgtaatacaagcgaaggggaatgcccattaatatgggttatcttccttgtagtttttttttcctcttccttgaacttatgaattaaatactcttataaaaaacacaatgtgtacattgtttactcccagccaagtctgattgcaaagaattatcaaagatccccaatgagataacctcaaagttaggggtgagcataaataatccacatgaaagttaggggtgagcataaataacccacatgaccgcaacccgcacaatctgacttgaaaataagctacttggatggatcagtttgggctttgggttaaaaagtgtaaaaaaatgattatttgagggttattctgactggaaaatacccgtcattcaaaactttgtcatccattgatagttacacaataattagaataatttaacagaaaccaaacttgagtgatattatgttaaatgctaatgtaaggaaccaaggatatagtacttcaaggatgattctataaaaaatttagtctaaagggttacattgaaccttgacaattgacattgttctcccggggtcatgtacgtagacaaacatacgtaaaaaattattggtaagtgaagtggtctctggtgcctaaaatattacctctctttgtcagacacagacatttatatagcagagcacattagcttcatttgtttgtgacaattaatgattatgattatgagaattataggcacaaagtatgacctacatagcaaaggaaccagccaaaacatacaaattttgctacagtgaaggagactttttaatctttcaaatttccagattttgttatagtgattagtagagccacttctttgttgatctgactcattggttttacgaccaatctaggattttctctatggttgttagtacttgctttacatggaattcaacaactactttgtcgtgtaatgtccatggtccaaacctaaaattgttaattacgatgttttttggcatttaatatatgatgcaaaaagaggaacaacaattgaattgaagcatgaaagttgaaacatattatagaggctgcaatattagatcctgcggcagagctacaaatgtgacatcagaaatgataagtggatggcaccatgatttagaatcagccattgaggttttcaggagtcataatttacatataatgcttaattttcctgaaacgacagatcaagaaaatcaaatattatgcatctggttcggggtgctgttggattctaatatcttcatatatcaaataacaagattggctgaccgtattcaaatttgtttgacaagcctaaagattttcgaaggtggacataccaagcagctgaaaactatgtttgacaaggctcattaacaaaaaaaatattcatgtttgaataaaaaattggctgaccgtattcaaatttgaataaaaaatttgctggggaataccaactaatcttgcaagctaggaaaatcctccaaatggcaacacccaagaaatactcaactctcttcaatacttttcttcttgtctttagcactaactgcacaaatagaaagagacaaaagtaccatgcatttaattaaacatctcacctctttgaaaaatattttaatgtaaaaaaatgccttatagaagctctcaattatccaattccttgaagggagcaaattttgtgaaccataagaatgaacagaaacatcctcctactaaggtaagaaccaaaatgaataatgttctatctgcgatgatggtctccccaggcttgttatcatcagggactttgctagattctttgattcatgtgtgcaatgaagttggcacaatggagaagttccccttggtacacacaaggaacgtttcatccatgataaggaggatcaagcttctttcttctttgtttgaagagattcaagaaacggatactccacttcccccctctgcaatactgtgtctcacagaactcttctctgtgataagaagagtcgaagttttgatccaagactgcaaggatggtagctctctttggagtctcatacagttagagttcatctccacccaattttatgtgcttgttaaggagatgggaagggcccttgatatccttcctttgagtttgcttaatgtaacatcagatattaaagaacaagtggagcttcttcacaagcaagcaaagagggctgcgttactcgttgatccgagagagcttcaccgtagagaacaacttatacaagtaatgagcaacaacagtttacaaaacaagaagagcaaggggttcgttgactttggcaaagtggaagagatattaagcagcattggtttgagaactccatcagattatgagggagaaatgtccaagttagaggctgaagctcagaaccaagccggcacaggaggactaattgttgtctccaatataaacaatctcatatctctggtgtcctattccaaatccatgatattcaaagatggagagagtgatagaaatgaagaagattgtaagcaactatcttcatttttgtataacaaagtatatgatagttcttcatcctctcagtccatgacacctaatgttcctgatgaatttcgttgtccaatttcacttgacttaatgagggaccccgtgattgtgtcatcagggcactcttatgatagaatctcaattgcacaatggataaactctggccattacacatgccccaaaagtgggcaaaggttaattcacacggctctaataccaaactatgcattgaagagccttgttcagcaatggtgccatgacaacaatgttccagtgaatgagcttacaacagaaggaaacaacaagaaaaagttgaaggaggatgctatagaccatatttctgcaaacaaagctgccgcggatgctgtcaaaatgacagcagaatttctagttggaaaattggcaactggctctgctgacatccaaaggcaagctgcatatgagcttcggttacttgcaaaaaccggcatggttagccgaagcgtcatagctgaggtaggggctattccctttcttgtaacactcctaggatctcaagattcaagattccaagagcatgcagtgacagccttgttcaacctctcgatattcgacaacaacaagattttgatcatggcagcaggagcagttgatagcatagtggaagtacttgaatcaggaaagaccatggaggcaagggagaatgcagcagcatcaatatacagcttgtctatggtggatgagtgcaaagtgaaaattggaggaagaccaagggcaatacctgctttagttggactcttgaaagaaggcactccaatagggaaaagagatgctgcaagtgcactgttcaacctttcagtttacaatcctaacaaggcaagtgttgttaaagctggggcagttcctgtgctggttgagttgctgatggatgacaaggctggcataacagatgatgcacttgcagtgctcgctttgctccttggatgctctgaggggctagaagagataaggaatagtagagcattggtgccacttcttattgatcttctgagatttggatcagtgaaagggaaggaaaattcaataacccttttgctaggattgtgcaaagaagagggagaagtggtgacaaggaggctcttggcaaatccaaggagcattccttcacttcaaagcttggctgctgatggttctttgagagctaggagaaaggcagatgcagtgcttaggttcctcaataggtgttgctctcagcctcatcattctgtttagtagagtagggtgtgtaatcacatcacttcacagttgtatattttgtgaatggtatacatgaaagattggtcatcatttgttgtttgcaatttttatggtatcaaaactttggagctttgtccattgattgctgattaggaaataataatccctggattgagtagttaattatcacttgggcaaatgcttgcttctataattttttaagaatgtagattgattagcaccattgcctaactttatttacttgtctgtatgtctgtgttgcctttcgaaattttagctcaatgtgcatttggtgaattggtaaactaattcaactattccacttacctcccattctttctgtttcactgtgatatatgttgcagacatccatgtaggttgcaaatcaaaagcctggattagagtggtgcaaactggctgactttgtcatttttgtatgaaatctaaaatttataaaattaaatttaatcatattaatgttcaggcccgtgagatggagtattaaatttaataggttaaatatctttttatatctgaaaaataagataactttattttttgacgtggagtatgactaatttctttacgacaatttatttagtcataaatttgcattcataagaacatctatttcatccttgattttaatgaaattttcgtttaatttttgagtttaatagtcatgcaatattaatgtaaaacattttactttgtcaattaatccaaaatcactactaatataaattttaagatatttattataaaaattaataaaattattatatataatagattatgattggatgacaccttacaattggtgcataatttattttctcaatttattttattaaatgatgaaaagacatttataaaattttaatttttttatagtttttattgttaagtctgtgaccaatacactagcctctgagttaactgagttagacatgtactgcaaaaaaaatttgtttgaatctacaatcttcacgttattagtactttactctaataaattaaattaataaatcaattataataaaaaataattaatattattatatataacactaaaatttataatatatatttaatgtatatatagatttacataataaattttacaataattaattttgatctaataatatattttttacatatataaatttttattaaacctataatttttatttaaaatttatatatttaaaaaaatacattgttagatcaaaattaattgttataaaatttattgtataaacttatatatgtattaaatatacattagaaattttagtcttatatataataatattaattttttaatataattgattagaacgtcatattaataataaaattaagattatatatttgaaatctgcatagatcattatttttaaattatttcgtaaaacatattttttaattacggattgacatgagtcatatgtttaatataccctttaatttatcttattttcacatgagtcatatgtttaaaccaagagtgcatagattaatttttaatgttatggtttctatttccagttttttacttattagatttcgaatttctcccttttttctaaaaaaaatatttgtcggggaagagtttatctttaattctttagggttggaatgatccaaattcgtcatgatattcccatcaattaactgtagatgtatttatttattttttgttacaatttattggcatttcagtttacgtctcttgacataatatattcataacgagatattgacaaacacttattattcttatttatattatcttatagaaagtatattgtttataaagaaatatgcaaattaaaacaaggcaacctaaatttttctttcgtctgaattccctgataaagttctacgaagcttaaaaaaaaatgaaagcactttgattatgtaacttcttctcttgaaagcaaactaaatattaaacaacgtatacattttttatacatactaagctgaattaatggtaatggatttttataatgatttaattaagagacatatttttcatacaacaactaatttaattacattatgtatgtcgttcatttgacaaaattaatgatagaataattttaatttaattttcacataatacattctcgaagaaaactaataattttaaatatgactaaactttgaatctagaatttgtctcacataagatcataaatgtcaaaatttgtgaaaatattttgaaatcagcggagtagaaacaattttcttttttttttattaatgttggttattgcagaggcctacagtggctccaacgtgtgtgcaacgcccaacagaacatggattcacaagcctacaacaagaagcttcaatccacactcaatgctaagatcgcttatttcgatatatatggtcaaaaacccaactaaatatggtaattaattactcactcattttaatttgcacgccttgtcacatgtttggctcgtgctaattttgttaattgataatttgtgaaggctttgcacaaactcttgaaggatgctgtgggatgcacatgacctaacttgccccgattcgtctaagtacctgttctgggatgctgtgcaccttactgaagcagggaactacgttcttgccgatagtggtcaataaaatgtgcttccataccttagtagttaggctattatgattttgattttatatacgcattttttccttaggataattaatcagccaattggaaggatctgaataatcctcatttagggtgattatattatttttttcatggcggtttaggaaacttattttatctatagagcatgtcattttgtgtaggtaaaacaattactttcttttgataatattaaaaacacttttggagctattgattggttaccttttcattaaattgtcattcttaataaaaataattctttattcagatgtgtatttttacacactactcttagaattagctgatgagaccatagcagtgatgttatatcatcttattttatcctcttacaaattctcttattactccaattctaaaataatactcttaataaattatttcacataaatcaagaaaaaataataaatagataaaaaaatgataatttaaaattaatcttatatcattaataatttatttataaattttgtagtctatcattaatataccattataagagatataagtgaaaaatataattaatgttacattaaaataattaaaatgataattattttagaagaatttttttcttacacactaattataataagacgtatgaaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattctttctcaaacacaatcctaatagtaatcataatttgaacgtgatttcactgccaaaaagaatagttaaaattgaaaaaaattattcctactagcatggtgtactttttatagttataaatgaatagttcaagaatcattcttttaacatactctcttgaatacactttctcttattagtcaatttattaagtcactttaattataaattattttaactacaattatcttatttatttgtaattttcacggtgacttattttcatatatatgttctagttcatagtaaaagtacgtctctagtaattaatttttaatctataaaaaatattaaagttttaaagttttttttacttaagttttctattcttatatgagattttcattttctttattctctcaaaataatattttcaatattttttctctgcttttctttggattaatttcaaacattaccatcatcattacttagaaacatatttatcttaaactattattattttatcttcgtgtatatactcgatcatcttaatcgtctgtatatttaactctatcatttaaaaaaaaaatgaattttaaaaaactttttaaatcttctcacgaggaaaatggccttatgttttcaatcatcacccttgtgtactgtaaagattgaactcaattcaatatcagtatgagtaggtataacttaaattacataaaaaaaggtagtggatactttaacaactcacatagtgatctctcaacataaagagtggtgtaaattttacaatccaagcgggccggaaaaagtaaagaattctcagttgcaatgcttctaaaattgcagtacataagtgcattattttcgaatttcatacaactttatgtgaaaatctgccgatatgttatgaatgaatgccctctcttattttgtctggatttaaggtaagaaatgaaaatatcgtgccgagacagattgcaaaaaaaatttaatgcttgaagaaccacaaaaaaaaaaatggcaaagaacacagctgctatgaaggcgctgagaagctaaacctaaacccagtcttcccacgatcatgctcaccctttctgagtatgtaaaagtagttaccctgaaacaagaaatatgttagtgaagaaatcacagaaaattttgatataacacacatatagcaaattaagaaaaggcatgatggagaataggagatgggtacaacaaataagagatttactaatcctgattaaaatgctaacctatcaattcaacagactgttcaccttaattaccttgctaaaattcaaataccaatttatagcagatagctgacaaatacatgcatacatcataagtaataagtgctcagttcaaaactaaatgagggaaaagacaaaaaaaagaggaaaactatgcaagcaacaagatttcaggattaaaaaattatatattctcttttctttccttcatactctttaaaatgtccaaatataacaaggttaccccaaattccttcatatatattttgtcttcatcattgacatttcacttctaactccactcaatctcccaacttttggttattttttatcttctttttaattaaatactagtataaagaaattaaaacagatgctgacctctaggcggaagagtctagtaggaataactactccacatcctactgacattcgaaaggattctaagaactttcgaggagagaagtgcttatattcattctgagttaatttagcagcattcccagaaccagcaaaaacatgtccatggattccatgttctctcagccacctaattggaagatcaaaagagagatctgcaaaagcagtaacagcaacatcgccaccaatgaagtcccatccagaggaatcaacattgtcatcattagacccatctctattttgcctccgaggttcagtaggacctaatcctctagttttaaatccccataatgttgttggtcctcctagggtgcaaactggagaaaaatcaccacccaaataaaacctttctggaaggggggatggcttggttttgaatccatgcccccatggaaacacagcaccagcagatatcccaaggtttagtgctgtattgtaaaacccaaaagggacagcaaagcgaacatcaaactcctgcattagaacttagaagagttaacagagttactcaagaaaaaatagttacaaaaaacagagcaaagaaaagaaatattaaaatgtagaagagttttcagcaacaaatgttttatgagcaaacaagtcccaaccatttttgtccccaaattgtaaaacactttcgtgatagtccaaggttcactttctggcaaataagtcccagaaattgaattttgttactcaagttagtcgttgacgttagtcatccactaacactattaaccaacacatgatgtgactgccaaaacggcaaatagcatgccacatcaaatgctggttaatggaattagtggataactaatgacagagactaacttgactaacggaattcaatttcgaattcttatttgctagagttaaatctagggtctactatggcattgctttacctcatacttgtgaaatccttgatggacatttgcactgagatttcactctcacagtctcactaagggatattgaacccatcaatggataataaggctataagcaaccaattaagttcttgtgccaatttttttatgaaaatgaaaaaataactacatggatcattcatcatatgaagcattgtcccaaggaagagtaacaagtaccatgataacaaatgacaaataaggggccatttgtttgtgctttttaaagaagaaaatatttaacttttttatagtaaatagatttttaaaagaactcaagaaaagaaagaaaaatccatttgagtgcttctcaaaatgcacagactgtattcccttctaagggaagagatcttctttgacaaagaagacgaactccttccatatataaaaaaaataaataaatataaatttttaaccataattttatgcttattaactccatcaaatcattttaaatttctgatcgcaacaattttaaaattctagccactcccaagattatttcaataattcttacgccaaaatcatttaacacgagttactaagtttcatgcactacacataaatttgcttagtaacagattaattggaggaaaagaaaagcatttaatcacacctgacgcagaaaccgcaagctcctgggatccagtgtaaggccaccaacatgagtggtggaaagaaaagcatatccttctgttggcctaagaggagaatttctcgtatcaattttaaatgtatacttcaaagatgacactaaaccatgcccaagctgcctccttatagacctggatgacatctgtgacggatctgttaaggtacgccatccaagggtgtatgctaagtcatggtgttttgtcgagattaagccaagagatgcacccaacaaccgctccttatatgaggatggctcctgccaatcttgggaaagcatggatatccgtgttacaataggagtcaaaaatcctttaactcgaggagcatacacccctacactcacctcagtcacttggttggcaccataggccaaagaagcatcacatagatcaccataacccaacaagttcttatacttaagagcaccttcagcagtccaagaactagtctacaaaacatcacataatttccacataaataaaaattagatccccttgcccttgacgacccctaaaacctaacatgaaaaatgttaggacaaaacttcaatacagttccattgctgttgtttgtgctccaattagaatttaaatttcaaattaataatccacattataaaggtttgcatcaaatgattatgtaagtgaaactccaattctgattgaaaaattgtacaaggagctgcatataagtttagtctacataggaagcgtgagaacatgagcattcaatctgtcatagacggtcaaggttagttttacttaaatctaaacttgactatctaagtaagatggaataatcagagttaattttctcacttctcacttgatacttttatatatttgcatataagtttctatacaatgcaatgcctcgaatcaaagtaaaatgtactcagttcgagtctgagaagaataaagtgtaccgagggtttggtataaacgccgaattcgccggaaactttgttatcggtttcgacaacgtcgacgatgacattggcagtgtttggaagctctcgtggtccagcctcgaggcgaaccttgcaggaatcgaagatttcgagaccctgaagcttggcaatggcgatttgcgaagcttgcataagctcctgcatgctggtggcgttctcgatgcctttcagctccgcctcaatcacccaatccttcgtcttcgtgttgccgtttatgaccacgtcgtgcactcggatcggaaccagctccgacgacaagcgccgcgtaagggtttccaccttgaaacgctgttcccgcaacttggacgctgcagattggggaattccgcgattcggctcctgaacgacgtcgtcgtcatcgttgtcttcgtcttcttcgatgtcttcgtcgtcgctaggttccacatcgtcgttggtggagtgttgagtgtgattgttagggttcagaggagttgcttcttcatcttctgtgtttgtcatgtgagactcggtcaatttgtgacacaattgagtagcgagtgtagttggcagacgctaccttctgttacaaattacagtgtttttttgaacaagagtccattacacagtctctttcgctagagcccagagatgtcttttttatttatttatttcttctgtaagaatcgaaggcaatttcaatttcatgacgcattcctcaattactgaattagattacttgacagaattcagagatatcagatactctaattaatttagttgtttttctttttaattaaaaaatatctctattttaaggcataaacatctattattattttttaatttgatttaaacaaacttttgagattatattttttttttcaattgttgcccataggattgcaaaatgtcaaagcatggttctaaaggtttggcttggcttgtagagcatccaaccatggtgatattagatacaggttttggttaatgaatttctaaattttattagcagaaaaaggtgttatttgtgtgacatttcaaaatgagtcagtctcattgtgtcaaagtaatatttatatttgagtaatgttatatatattaagttttacaaaaatacataaaggaaaggaaagagataagaagagagaaaaaataagtggatgatacaataagtgatgagataaagataaataaaaagaaaatatcaatataagaaaaatattttaaattttttatgcgtaaacaatattattctttatattttctataggttcataatgtaaatggaactcgtgtcatatttatctaagaattaattttaaatttcgtggtatatcaaataatgtttttcaagatatatacagaaatatattagtagtaatatagtgtatcattgtattgaatacagtaaaatgcatggaatgggtttgaaaaattcttaatcctccggctattttttatggtaagttttaaatatattttatacttttaagataataaatatttttactttttattcaatatttatcataaaagatagtaggaagattcatagatgaatatagtaagaggatttagcattactgaacgaggaaagagatataaaattaattcattggtatgtagaggtcaataaaagagcaagtaatagagttgtaatgttctgtttcatctagtttcataattgacaatcactaccctctattgtcaaaagaaagcttgcaacaacaaatgcaaaagaaagcctcactctcgttaatacttgatagttttgaacttttgatcaatgcacgtgagcaggactatgattattaaactattagtttgttcggaacatatgaagtggatgagaagatttggacatatcttgatcaagtgatatacaaaaagctattttctaggtgcatttccataggatacagttaatataacaaaaaaaaaaaaactcacccaaaagaacttcagcacaccattatacttcaagtaagaacttttttatgccttcacctaaggaaaaaaaggatcacaatgctaaaagctctcaaaagacttttaaaaattacaatctgccacactgatttcaacgtgcttctgcagatgcaatctcaatctctgcccaccaaagtggagaaagttttggaaccgcagattcaggtgttatttttgttatctctgtgagtctctcactcacatctttcattgttggtctcttctgtggatcagggtggacacaagatgtaatcaattcagcaacttgttccagctgatcttcttggtaagatactagaattggatccactatttctttgaggggctggtccacttctaaatagtgtgatgcccagttttcaagtgaatccccatgttctactgaataaggaagacgacccgtgaccatttcaaatagtagaacacccaagctataaacattactttctggagttgctagtggcttgtccatagctcttgtctcagctgaggctatgtcattggagaaacttaaatctgagagtttggcagcgtagtcatcggtgaggtaaacggctgaacaattcagcttgattaaggccataggaggatccaattggtgcatatgttgcaagcaataagccacacccgttgcaactctaagtcttgttccccaatccaagtgctcagcctcttttactggaattcacaaaaagatctattgacagggataataattggagagcattgttgcttccaaagagaaaaggaaacatagtataatttcaaatattgtaatggcaatttcacattgaaaattacaaaattatgagcgagttttaataaataaggagtgaaacctacacagttatgtgattatcaacaaatttcagccaataattgacagtatgatagaaagagtgtgttattagcatttctccttagtgtgtagtagttactctaaaatgatacattacttactgtgtaaatgctcaaatagtgttccgtttggggcatattcaaaaaccaacattctggtgaaaggctcctcttcttcacagtatccaataagattcacaaaattcttgtggttcactttcgacaatgtatctatctgacaccatgatggttaagaagttagtaataatcaaatttcctaaattgcaattctacagttaaatttgctgggttttttttttttttttttttttnnnnnnnnnncagttaaatttgctgggttttttttttttttttttctgttatgataattgatgtaccttgcttctaaattgagcttctaaagcttttgaccaattcttggatgatgttatggaaacaaaagctacagctatttcaacgccactagacaaagttcctttgtacagtataccaatgggtgaagtaccaattacattactaaaatcttcacatgctgcttcaagatctgatctctttaacttttgcgcacctgaaaatgtaaaacactgtcatgcatgtacataggcagaaaacatacatataagcatgggaaatatagctcaaagacatgggaatgcaatcattcaaagctaaatcaattggatgaccaaagggcccaaagaaaagttaaataagttcctattatttgtcatgtttcaggaatcctgagtcaatatgcagtatgggatttagatcttctgtttttctaataataaaggacatggtccttcttggaaagagaaagacattttattttattttattaatataactagtagactctataactaataatgtaggtctttgcatgataaaaattatgtgctgcttatagccattgttttactcttgttaacttatagtaaaagaaatgcttagattcaccagttacaaatgccttctgaagctgtccacttagtcccatggcccaaggtctgacattagctacctttgttttacaaagatatatgccaatgcttgaaaaaataagaaacacagcaccacctacaactccagccaaaataggaactgtatgaacctttgatgaggtgcttttagttttagatagtgttccagaacctgatgtagagtgggaaggagaagaatcagacgcctttttcctatgaggagctagctttggccctggtggttttgctgagcctgatggggaagcagaaggaggagaaggtttagaattttgtagtagaccacgagtaactttaccttgatcaatatgccttcaaagaagagaaaattatgtgagtttgttttttttagaaaaaagaaataggataagattagcctataataatagcatgagatgggcacatcttagaacacaaaatgcaagtacataagaaggcacataattcctgagttggaccacctttcaatcaattagtaacataccatgtggtggctctttctgtacaagctggcattttagcagcattagttagctgattttcatctacttgacattcagaaagcatcctcagttcatttatttcgggagataaaccaacaagaaactcattgttatccagcaaactgcaataaagaagaaactaagtacatgaagagattaaaaaaaaaagtgaaattgaactgtcttaatactatcatcatcatcatcatacaggattgctagtgagatattactccctagatcagcaggtagatgtccactgaagttgttgtatcccaaatccaaaacctccagttcttttaactctacaaatccttcagggatggtcccagagaaagagttgttccgcaaaatactgtagcatattcaccctctaattataagaatgaacgccaatatataaatcatgaagaaaaggaactacaaagtcaattccaccaagtaacaaacaattacttacatagactttatgctgacaagtttcaaaagctcaggtgccagagttcctccaaggcagagatccttcaaattccttagcaaaggaaaattttctcttcattaaaatccctcaagtttaacaatacaaacactagtgattagatttatcacaagagactaatgttcaaaaattattgtgaaaatagccactatcggtagagttgatcacttgagcatacggttttagtgttttaccaagagaaaataaagtttaaaaaaaaacttggatctcacatttgatgacacaaataaagagacagattaaaaaagcatgtatattcatcttctttacttgccctgcttgttcccataaattataccacacaattggttacaacttacaaattacaaataatcagtttctgtcaaaacagataacagaataagcacttacaagatcacaactgttccacccgagcactcaactccaaaccaatgacaagggtcaacagaagcctcatcatcaacccaatttgacaaagcaccaaaagggtcactcactattttctgcctcaacttcaaaagagcattacctgcacacacacacacacacacacacaaaccatgtctcagcatctatcttccaagtagccacaagattccacaaactcaaaattccaccactactagtcaagtaccttcttcattcaaagaacagcacaaacccaagttgtgaaacaagaaaaaaaccgccacaaagcaaaaagctatagaaagatccttgaaccgactgagtttcctgttcttgcccattcttgctgcaagaaacaaaccttggatggagcttaatagcccaaggaagcaaagtttgaagttttaaacatattaaaaagaagacaagttcaagaacatgtagagtggaaggagcttaagtgtgatatctaaggtgaagcaataaagcatggactggttctaagttctaagattgtcgtgagttgtgacacctgcaacgcaatgcaagagagattggtgaatggacccaaagagacttgaaagcgtgttcgctgtcgtgcagctaacaagtcataatagtaacggtggaaggagtgaaggacaacaacatattcacataacctttttaatacgttattgtgaatttgaggaaaaaaaataaacaaaaaaacttgtcatcctattaattttttccaaatacaaaacatgtttcttataaaaaatattcgagacagtatcatttaatcaaatcttattaatatatttttaaattcttaatgttaaaagtaagagtgtgtttggatggagtattttaaaattttagggaatttaaaattcaagggaattaaaatgcatcaattaaaatccttaaatttttaaaattccttgtttggataaaccaatttaaatttcttgaatttcaaatttattgtttggatgaaataatttaaatttcttatattttgaattctttaatttgtttgaattaaataattttaatttattatatttcataattttttcttttttctccaattatattttaaaactataaatgatcatataaataaaaattgttatttttatntcaaggactaactaagactttatttctttttcaaaaaaaaaataggactttatttatttattttctttcgaaaagttaattattatgtttgatcgattgttaaaaagtcttagtttaattagagtattgacatatcgacttaaaactcttggtaaaatgctgttaattattttgtaagatttttttatttatttatgcttttgcattttttggagatatatataaagaaattaaatgccaaaaatgaagaatatatttttttataattactctcttgaagtaacgtaaagagagaagatcaatcgagagagcgagggaagtgaaggtccgcctccgtgaaggtttcgagaaattttagaattccttctattttgatgaaatttagaattacatacttttaactaattaaaattacgttttcaaattccaaaattttaaattcctttcaataaaatatccaaataagtgattttaaatagaagtaatttaaatccctttaaaaattactttccccattttaattccttcatccaaacatactctaaaagattttgccttgtctttagttaaatgatgtgatcaccacacctttcttgtttaacttaaaagatcaaattaagagttattattttctaaattttattacattactaaggactaaggatatcattttttataggcttaattaaatatgtttttaatcatttaaatttgaatactttttttatactccaaatttagaattctttttttagtccttaaaatacacaaaacaatttttttaatctttttgttgcatagtatgactcaaacatggaacaagagatttatgacaatttttaactggcaaaatttgatttttctattttatattttaaagtatgtttttgacaataaaaaatcacgataattaagtcagtaaaaaaattaaaaaccaattaatcattttaaaaatcactttaatttttttattgacttgattctaacaatttcaaaccaccaaaaaattatactttaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttgtattttcaattatgtcttatatataactaattgaaatatttctataaattcattcaatttctaataacttaattaaattatattttctcactttttgagtatgtgtttttatcttttatgatataaaaaatttgatataaaaataaaagaagttttgttacagctattttatttttttcttgtcacaaaattaaaaatatgaaagaaaaaatatatattttcctctcatatctcaaaattgtgttatttaattaactatatcagctcatttgttttggtacagaaactatctaattaatttaaccatttagttatataaatttaatcaaatatttaaataacgatatacgattaatttgttaaatatatttgacaaatgttaaaaataagatatctcttcatctcctttaataaatatatacttatctgtaaataattaagtgataaaattaattaatttgatcattaatcaagcacaagtctaggaggagtcgcatctgaagtctgaacaagtaacacgagccatataaataaaaataaaacagcagtaaggatatcaacgaatgaatgaatggctgtgttttgatgaggattatatgatgatatgagaaatagatcgtaggttttggtgctatttaatatttatgtttattctccgatgacttgacttagcagctattgttatagttggtgatgatattaagacatgcatcatgtcaatgtctgtctttctcctatacttggtaaaagaccccctttatagatggcactatcaactttataaacaaacaatagtagtactttttcttaatatattttttgttattaaaaaatataaacacagatattatagagaatatatttgagtgactagctagcttatttagactttgtttaggagagagattttagaggggaaaggaggaaacggaaaggtttggatagtaacatcttattgtttgggagttttaatttttgaggaaaaaaatttgaagatttttaaaactcctctgaattcttttaaatcattaaaattattgtttccccaatttggagatttttagaaggaaaagtaataaaattactatcctacaccagctacaaattcaaaattaaattttatttgtaaaatatagagtgtattaattttttaagtaagggtaaaattgtaaaaatttcttattaattcttcatttccctctcttaatatatttttaactcccaaacaaggaggaatgaacttccctcattttcctttctttccttcccctcccttcccctttaatctctttccttcccttcccctcttaattcccaaacaaagccttagtagttgcttaatcagtctttattatataataatttgttataaaattaagtttttttaactatatttttagtcccttgcagtataaaaaaaacaactatgtttttagtcttataaatctagtaagttttagttttaatctttcaaaataatttgttaatgatttttataattttattttttaaaataattattattattatttcctgctgacatcatatgtatataagtattataaaaaaaaattctctctctataatatatatatatatatcatgcattatataaaaagtatattctaatactattttattagcttatcaaatttaaatataatatatatcattaaggaatttctatttccactcctcctaatttataatatactctcctttataattatttttactaaaatagcttggaaattgcactccgcttttttaattcttattgcctccaactaggttaaagcagagtgggataagttcagaaatttggtttggtagaattaaggataacgttcgtgcaaatgagattattagaaactaaatgcatggaatgatgcacacgttccataatcactatttctttttgttcttgtttgctatttaattttgtaggtattctagtgaccaagtttcaggtatattgctctcaacattaattaattaattaattttcttcgtatgtgttatttagtgatgccatccattgtttctattaggttttctgcaagtactgtaggtgtcaacgggttcgatgaaacttaggatttgtaaagaaaagggggcatgtgacttggagtagaaggttcaccagcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattagtaattagggaaagtgaaaatagcaattcgctctcattatactttcttcttaattactaaactaaacttcaaaatttgttggcacactatatgctagaaagtgtaatatttacaaataattctaacctgacttattacacggagaacgagtacacatacaacttgtgctccgcttatgaagtaagccggataattttacttattcaaattggtaagtctatctgagtatgtgacagctttctctttgtacgtcttaaacaaaatattgatttaattttctacctttagactcaaactcttatgtatatttatacttttgtgataattaaatgctacgtgtagatggataattttagtcttttaaacattttcttcgagactagttttaatatcttttatggaaaagttgttgaaatagtttatttaatataaacaattgattgatcatctacgtttagcgaactctaatgtgaagacactaaattgaatttttgatgcttgagaggggatgcgacagtttaatttttggggggaaaatggttttatgagaacttcggggatgttgtcattagataaagaatccagacaccgctaaagatgtttaaattacatacctcgctcttgacactgacataagaactactcagattgtgaccttttaattttcataatggcacataacatcattaatgtacattgatttgcataaactctttcagcataagtggctattatataaaatagttatcgttataatttatagacaatgatatataactacggaatataatctatatttcaaaattaatttaaaaagttttagaatgaaaaagagccatttcatttttataaaaaaagagaggattacttacgtctatgtcatcaaaattaattggttcagacaacattgacttttctgtctttattttatagcatttttttctctaaattaacttatgtggaaaatcacatcatttcatctagaattgacttttttttagctatctaaaaactataattaacaagtatcaaagaaaaactatataggaaagctcgtttagattggtcaaacattattttaatatgcaaacttaagttttatttgtttaataggtaaacggagtttatatacttctttaagtaaaacaacactgttcgatgtactgttttgcagagggagaaaattcttctatggggtagtaaatttcgtttcaaactacatacaaacagccaattaatctaacattatttttgtcataatctatcatgtttttataataagcggctcaaaatttatttaaacccaaagataattgagttgagattgaatttaaaaagaggtgtactttttagtatgtttcatgctatactttagattgaacaataccgactcaagctaaggttacataatattgtaaaaacatatatatattttttaaataaaggataaattttaaaaacttgttttcttacttgaaactatatattatgataattcttttacattgatagttttttataaatgtgtatattgtaaaataccttttttattttttgttgatttatttaaaaaaaaaacccaattatacatagtagtaatatattttttaatatgataatacttttatttaattgtatgtaaggtaattttcaattaaaaacaagaattaaaactaccatatagtatacaagattttaaggtttttaaaaatactaaagactctgtgagttaggggttctattgggcattggccatgttttaacgagaatttattcattatttgatagccagttactcttaagttattttttcagttgaaaatgttaaaaaaaatgatgacgagagatgtatctacacttctattatgcccaaatactattttacttttctaaaaccagccctgcatatgcattatattgcctatctttctgtactcctaacctcattccacttgaatagatacaaaaagcccaagattgttctcttcacaaacccaacaccaagcccaaacacattcatcatagtaaagcaaatgccattgagggcaaaagaaaaggtaatgtttgcattaaatccaacgtattatttttcatgtttagcatattgaatcgaattcagaataaaataattttatgactaattctggagcacagccaaggcaccaatgtacttttcctctaggaaggtttttggataaacattgtccatcctagttctgaacttcctacacactttcattctgatttaaggcacacacacacacaaaaaaaaaaacaatataaatcaagagaagctggggtcatgttaacgtgagcgacatgagaattgagcatcaagaaatttgcgctataaaataagtgggccaagcaatcaaatcaacactccagaaaagcagggaaatacaaaatggaccagacccaaaacgaggtccaacacacacggttcccacgatctgccccaatgattattgtgcttgtgtatgagcaagaacaaaacttgaatcagaaaacggtaacagtttcgacccctttgaagaaaacttggcagcatcacccaccagacaataaatttcaaatttcgtgcccctgccagaggaacctctcacaaagatcattgtgtgctgtcagtacatggcttactccatgtgaaaatcattaatgttgaagtgccattacattacaacaaataatcaaaacctagctcctaagtcctaacaccatataataataataatacgatactatccatacactgagattctccagagactacacgattaattattaattaatatatgtaatgtagtaacataaacgaaatgaaagtgagaaagtgtttaattatcaacataaatatgatttaaatttcatcggtaagttgtctgtgactctgtgagctgtaactaactgaggggtaggtagctatctggtgtggcgtgggagcacgaagaagcatgcggggcaccgaatcaagccgttggcgttgcaagaagaacagcttcggaatccgtttttctcagagaagactttgtggcttccgttgcactcatcgcacacaacgaatcggaagcctccgcaggagtcgcaggcgttctggttggagcgcgggaggcgttcgatgaggcggtggagctcgccgctctcgtggagctggcggacgtccccgccgacaaagacgcgcggcagggcgaggttgcttcggcggtcgaggacggcaaagagctcgtcgcggaagcggtcgtcgatggagacgtcgcgttcgtcgacggcgacgcggaggccgcggaggatggatcggacggcgcggcagtcgtcgaaggtgcggcgaacgatgcggagggaggtgaagtacacgacgacgccctggtcgaggcctggcgggagcacggcggggatggctgcgcgtgaggcgccccaggcgcggagcacggcggtggagatccggacgcggcggaagagacacggagatttcggagcggccggttcgggtttttcttggaggaggctctggatgtctttgaaggaggaacatgagaagctgaaggagcgagttcgagaatgcgacggcgatgacgacggagatggtgacggcggtggagtgttgcggaaccggctgggttagttaagccacggtggccacatgagaagtaatggtgaggaggaaagggaaaagggttttgagggtagtgaagagcggagagggtgctgtgggcatgcaaaggaaacgaaacgaaacgaaaggggggagagggttataaatggaaacttggttattaaaggttcaaccaggatgcatcatcatcgctaatcataaccnnnnnnnnnnnnnnnnnnnnnnnnnnnnnnnnnnnnnnnntgactacggcttcacacatgaaaataaggaagatttaaaaaaaaaagaaaacaatgataaataatggaagaagaagaagaaagagatacagaaaaagggtgtaatgtgtagggtatgaaaaaagttgttgtattttttcggttggtctattgtgcactgaagaatattttattatttttcatagtggtttattttcttagttagaaatagatcgagcttttttaattgacaaaaaaaattgtctcaaccctcaaggcaaaactgtaaaacaccttgccattgaatggaccatagtaaacgggtgatgggagagttcgagtagttttaagtttaaattttattatttgtaaaaaaaaaagtttaaattttattagtattattgtaaaaaaaaaaatagttaacatatgcactaatgtcattattttttattgtttttaagtaattttgtttgagatatcattagtatacattaaatatgaatactaatttttatagtgattcaaacattgatttattgcctaaaaagaattgatttatcagattaatactaatgtcaatactttttttatattgctagacccaattcgcaatactaatatctctttctattaaaaaattactcacttcacacttattaacaaaagttagttaatatctcggtataacgaggctgcttataatatctatctcccgtgcataggatgaagcctctggaaggtaagtagttttttgaggtcccgttaaaagaataagtttcctttctaaattatttttcattaaaacttgatataaaaccaaaaaaaaattatgtgaaatagaatctcaattaagcaaaatatatcttggaaatgatctcatcaaatacaattaaattaactgaggtttgtttagactagttaataaacactgatgtaatgtagctttattttgttagaaaatatacaatgaagaatgttatgtcatttgagaatatatgtgagaaatacaaagagaatataggaataacaattattagatgaaaggatatttgatagcgtatctcaattaaagatgtcaatatcatatataattggtaagtttgtctcattagaaaatgttaataaatatctttcaattttcaaatcagttttttttgtattccaaggaacttaacatcccaaattaaaaagaaaaaaaattatgcacttataatataaaaactaatatttataattaaatgatattgtaaaacttatattgtatattgacattaaactcaactaaaaacctttacagaaaatcggcaagcaaacataactgaaccctcgtaggaggaacatcaaatcaatttataatcaaatccatatgaaccgaaagttaataaagatatttgactgaaaatgcaatcaattatagtttttaaatttgtaataatatttacaaaataaaaataatcaatactcaaatattttatataaaaaagaagaaaaaaaagcaactgtctctacaacaaatattataaaagagaaaataaaatatttatataaaaaagaatataatgtaattaaatatattccaaataaagactgtaaaaaagaataaaatattttcaaaagtaaagaattttgtgatatttattctatattttttaattgtttctaacttttccaacataaaaaaatatcaaaatttaagtaagtaaactttttaaaaaaattaaaattattttctaatttttgtacaaataaaatttaaacagcgtttctttgaaaaataataattactttttcattataatttttttatcaataaaaataagatgtcattaaaaattacataaacagtacaaacaagaaatgatctaaaaagatactttggcaacgacaaatgatgctctgacctgagatctattgaatttgagaagtaagaagtgagtctaaggtttcaaaaaataattggacaaacaagaaattatgagataatattaagagtagaatcggaaaaaaaaattagtattactattaactaggtgttaaaaatctgaaaaactttatagaatatcgttttaaaaatgtcacaaactattaaaataaattattttatcaaataatcctattttgcttatacaaataattttcaaataacttgaaagtgacattaagcacactcttaatcacctgaccaaatagtattagtgcaaccagtcctaccaaacaattttccattagacatttaaggagggacaaaaaatctaacatttaatcctagcaatggccgtttggattttggataatcgttgtcgtttcctaaattaaacattaatacctctagctgataaagaaaactagctgctttaaaggagaagaagcaaattagaagaacatagataactgagggggaactaaaacttcatcacattcttaatcctctagagaagagaatctctccgtaggataccttttggtcaaccttcaacgcatcgcgggaagcaagaactgtgcatgaaagaattacaataatcattagaacactttggatgtttattttaaacaaaagatagataagaggactacataataaataaataccacaaatttgatagaaaagttgtgctgctgatgtccgtgtcattccagcagctaggttatgaagggattcaactggaggagctccaggtgtgtcaaaatgtgccttcatctgcctgttgatcaaattaaggtcaataaatttcttaaggttattaagattaataaatttcttaaagagactcatacgcttggatggaatcggttatcttgtcattaggatgattgatgttcacttgtatttgagtgggtcctgtttccacgaggagttctgaaaagaaatttatgagactgatgtatgtgctataagtggataaagaatatatatcattactgttaaagaatacactagctacttctaaatatgtctagaattttctcaagaaattaggaaaggtaggagtattgtagaaaagtatagagtattctagaatatcagggaatggtgtaggctagaaagaagactatggagaattctagaagaagaattctagccattagatcaaataaatctccaccatccattaaggaggaggaatgggtataaatacccatctaggtaggctcacttgaaagtgagaggaaaaaggaagaagatagaaagagtatgaggctatattgggtggtgtgtaggaaaataattagtgagtgtaatttcctacataaataaaagtttttctttcttttgtcccctaaatctttctcaacaattggcatcagagcttgacggtccgggaccgtctggaggaggtttcagtgagcacaaggtgcgtgcaccgtcaaggcgctaagaggagactctgcctgtgcacagtctgggactgtgaaactcattggtccgggaccaaagagacttaattgacgctgagagtcagttatcatggcagatcttgctagtgtatgtggtgggattaggaaactcaatagtcacaactatggttattggaagacttgcatggagtcctacctacagggtcaggacctatgggaggtcgttgcaggcaccgaaatagtacctccgccaaaggagagtgttgatgccttgcgaaaatggcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatctcacggtttggaagaggaagaggtaccagaagaaatccaaggagaagaggagtatgcaccgactccaagtagagacaaagaaggttcatcaagcaaagccaagagtccatggaaaataggcctacatcaatcaagccaggaggaccctcaactaccacaaatggagattaaggagtctattcaaggactacggaggacaacaaggcaaatcaagcctaatccaaggtatgctaatgttgcccttgttgatgagtctataccttctgagccatcttcgtatgaagaagcagcaaaaagtctcaagtggcgtgtggcaatggaggaagagattaaggcactaaatgaaaatcaaacatgggatttagtgccaagaccgaaggaagtgaagcccatatcctgcaaatgggtatacaaggtaaagacgcatccagacggctcaattgagaggtataaggctcgacttgtggctcggggtttctctcaacaatatgggctagattatgaagaaacatttagcccggtagcaaagatcacaactgttcgagtcttacttgcgttggccgcttgcaagtcttggaagttatggcagatggatgttaagaacgcattcttacatggtgaacttgacaaggatatttatatggaacaaccaagaggcttcgagagcaagatacaccccgagtatgtttgcaaactaaagaaggcgctctatggcttgaagcaagccccacgagcatggtacgggaagatcggtgagtttcttgtgcaaagtgatttcaaagtcgcttcatcagactctagcttatttgtgaaggccaaggatgggaaactagcaatagtcctagtctatgttgatgacttaatcatcacaggagactactatgaggagatacaaaggacaaaagaaaatctttcaattcgttttcagatgaaggagcttggagagttgaagcatttcattggacttgaggtggagcacacagaggaatggctatttctgggtcaacagaaatatgccaaggatcttctacaaaggtatgggatgcttgactgcaaacctatctctactcctatggactccaatgtgaggctattagaagatgaagggaagaacctagaggatgtcactatgtaccggcagttggttgggaacctcatttatcttacattgacccgaccagatatttcctacccagttggagtggttagtcgatacatgagcaatccgaagaagcctcaccttgatgcagtcagacgcattctcaggtatgtaaagggcaccatcaattttggtattctatacaagaagataaaagactgcaagattatgggatgttgtgatgctgactatgctggagatagtggcacacggcggtcaaccacgggatacttctttagtctcggatcaggagccatatcgtggtgcagcaagagacaacctactgtggcattatcaagtactgaagcagagtatcgatcagcgacaatggcagcacaagagagcacttggctcaagcagttgatggaggatcttcaccagccaacagaataccaagtaaggattttttgtgataatttatcttccattccttggcagaaaatccagtctttcatgcaaggaccaaacacatagaagttcactatcactacataagagaaaaggtccttaaggaagaaattgagatggtgcctatcaagacagaagagcaaactgcagatatccttacaaagggtcttcacaaggcaaagtttgagaagtttcgagaggcgctcggcatggtctgcaagtcgactttagaaagaagtttgccttgagaggaaagtagctagtgaaggggagtgttaaagaatacactagctacttctaaatatgtccagaattttctcaagaaattaggaaaggtaggagtattgtagaaaagtatagagtattctagaatatcagggaatggtgtaggctagaaagaagactatggagaattctagaagaagaattctagccattagatcaaataaatctccaccatccattaaggaggaggaatgggtataaatacccatctaggtaggctcacttgaaagtgagaggaaaaaggaagaagatagaaagagtatgaggctatattgggtggtgtgtaggaaaataattagtgagtgtaatttcctacataaataaaagtttttctttcttttgtcccctaaatcttcttcaacaattacagcaaggctgcttctaatattagagaagccttaacaagtaatatactataaaaaaaacaagtaatataccttgataaggtgtgggaccatcttcatagagtctagctaacttgaaatttacatcttcagctagtggctcaaggcctccactgctgtttgcagatgatgaataccttttacttttgaatctgctaacagttctgaagaatcagactaacattaatctaattcaacaagatcaaaactctcacctctttttgtccttaagatattcagatatgaagatggaatggacattgaaactataatgagcaattgaacaatagaacaacattcaataggttataaattgaactaccttcccgaatcaaaatctgaatgtgaggcaggaccattttcagacgtcggtcttggaaaggaatgtacactgcctcctagaatatcacgtcgaagaacaattatcttgtattttcatagttatacgcatatgttagagaattcaaagatctaacaaacaaatcaataaaatataccagctttcccagatgagacctgaggagtagcttcatgccctctcaaaaggctagccgtcagtttgtccatgaggatatgttcccgagccttctccattggaggtgcctggtagtctggcctactgtcaaaatcttcagaaggcttcacatttggacattttatcagaagtaagctacatttcctcctaaaataaagaaaaatcaaaccacaccaaaagatgctgcagaagactaacaaattgcatgaaatattcattttggactcctggaggcgatgaaaatgatggttctggaggatggtgggctgaaatcctttctgcataaaattgagtgtgttactttctgctaaaccttttccatataaaggttgattattttctcaataccattttaacaccccccagagagagactctatgctgacctgaaggtgaatcatgaggtggttgaatgctcttaatccataagtcaagaataggttttggataatatatattgtctttttcagcagtaaataaatcaccaattagcacaacgggtggcagcttcatgtggttggctatctttgttgaagacataacatcagtttgctgcaacaagaagtaaaattttgttgtgtatgttgttgaagatatagctggattactaattttatccgctcctcttttcttttcttattttttatgatattaaactctcagctcagtatttttccttaaaaaaaatctggtttacaaaatatcatacatgatctgtctcttcggtgcctagctgataacatacatgaataagcatttcattcaaaaaccttggatgtaatatgcataatgaatatcaaatgaaaacctttttccttcttccccttcgtgagacaatgtcagaagcattctgaagccagtgttgatatatgtgagcaggaataatggtttgttcataatccatttcgatagccgatggttgtcctcttttccttttatttggtcctcgccttctaggctcctgttgcattgcactttggttggtcatttcttttctcatcaatcgtaatggtcactgtactattaaataattatgacacctgtctaggtatcatgccatcaataggttgctgaatgtctgggtgtccaggatgaaggtcttgaaacgtatcagctgcagaatagttatatgtcagcaaacaaattcatttctttctttttcctttttatattgacaatgtttagttatctctacaacatttctatactttaatatttgcttgactctaaggaaaaaaaaaactatatcttagaatattttcacagtaaataataatactgctgaaatgtagtctcataattactataataatcataataattcagtttctatgcaaagatgcccttttacgagtcacaacttatgatactaagataaatttttactagaacgtcaccaactgaaaaaattacaattgcttaccttccactgtcatttgtcaattctgaacctcttctctagtgagaaaggtagagcaggaccaggagagatacacaggttgtatatgtaagcaatgcgctatggacactccataacttcaatccttaagctacagcctatatgtacaacactaggaatatgacgctccattactcccttacaatccttaagctatatgtacactttaagttgtagccaagctcaatcccacacaaatttccaagcttctaagttatgaggaggaatggaatttgatggagttgtcaaatcatactaaggctgggtcatgactgagtttggtcatcataactctcaacatcaacaacgactcattcagcaaatggtttcgatgtcacatgatggatgggaatgggaatgtaactggagaaggtgttttagggaaggagaagtcgaaacagcaataaaatttctagaggatattcagggtctggtcttacacctagatcagcaggacagctggaggtgggaggggtcaccaaatggtagttatatggtgggaagtgcctacaaagctttaaacagtgtgacggagatacagggtcagaaggaggtattcatagacctttggaaactttgcattccaaacaaagccgcttgttttgcgtgtagattattgaaagatcggctgccaactaagaggaacttggctcggagaaatataaatattgatgaccctagttgtcctttctgtggtaactatgttgaggaggcagcacatgttttttttagttgtcacaagattatgccgttgtggtgggaatctatgggctggatcaatgtgtttggggcatccttggttaccccgattgatcacttcctccaacattgttactgtaatgttagtggcattaaaataaagaggtggtatgtttggtggatagcattgacatggaacatttggttccaccgtaacaagatcgtcttccacaatgaaaacttcaatggatctaagctgatggaggatgctttatttttttgttggtcatggctagttaatctggagaaaggatttaatatacctttctaccattggtctagtcagctgagtgttgggttttgctagatacttttttattttgctctttaacctccttttgagtctaaccttaggctgtcctttggcatcttaatgcaggttgttatcatgtattaagctgccaaagttatggttggctccctgggttggttttctttttcagtactacttgtactcatctctatctttcatatatatattatattatctttgctgataaaaaaaaaaaaaaaaagacttgagtttggtctagatggtacagtactatcttccatcaaaaacccagtattgatataagctacatgagtagggtacacacaagggaaatgtggtggaagaaaaagaaatgcaattaaggtggaaggaaagacatgtatcaaaatctaccgatactttagatgacacaatgttaaaaagaaaaacaacattatttaaaaattttaatgtttacaaatgattgttatcctaatcacctttggtgggttcgtcttgatgagttggggagggtacaagcgtggttggaatttgatctcctgaagttacatttacctgtgtttcctcatcttcttcaatatcaaacctgccacaacattcaaaagaataaatggaatgttgcaagaaattaaaaacacttatacaaataaaaaaggatgatggaaactaaaaacctctcaaagcgattgtacgtatccgtattagcttggaatgtttcaaagcgttcaaataaggtaatattctctgcgtcaactgagaatgataagagttagcaaatggacacttgcatggactatacatatatatgtttagcaaattcaaggaagaaaaccttgatggagaagttctgattgatcttggtcctctcttgctccattattagtgaagggttcatccacattatcaagtcgctgcaataaacaaaagggtataatggatcaactcaacctaattggagatcaaacctagattaatttattgattagttcttttcgctttctaattccatgcagtgagaccacatatataccatagtaaaataggcgttatgttggaatcctgttgcggtgcctgtgttggaaaactgaagggactgttcaatatctgccatgttcgtttcaccggtccctggcagagtaacagcctctttccttaaaaaaaannnnnnnnnnnnnnnnnnnnnnnnnnnnnnnnnnnnnnnaaatcattgaaaaaatgcatgacattactcattgagtcatttagttatctaaaaggtaacgtatactatgcataatttgaataacaagagcaacaaaatgtgactaacttggccttggatttggacttggggagcaatgtaggatctggagcagtctttactttccaggcttcgtttatctcaaccttttttacccgtaggaaagaaatgcagagaaatgtaaagaaaacaagaaaccgaattcgtaggaaatgttaattaatgttgagctctataccagaaaacgggtcacgtcctctgcgagaaaacaaggtaaaattaaaaaataagtaatagaattcagaaacgtgagcgctttgattttaatgctacactatcaatgaaaacaaggattcgaaagtttaccataaaggagcttcacttttctctcatagacaatcactactcctcctgatgaaacgcaacaaccattaagcagggacgtggagatatcctacatttctaccaaattaattgaaatggaaaatgagattcaagatcacagagcatcaaagagagcgagtgtgcacccatcagaattccagaaagtctaagagccataggaatcgatgggtttagaatctcttcgctgcacaagaaacaaaataaatataactctgcactactataagaaaaacatgcgttcaggtaagcaaccgctaccaaattttgatgatgttgagcttgtctagctttcttcggttaatcttcgcgtgcattgtcgcagccatccttcatcagggaccaagtgagaattcattcctcattttagaaataaacttccaagttaaaggaaattgaaatccagaatcaccgataatgttacacggagacagaaaacaaattagaaaaagcattcgtaaattaaaacaacgatttaatttagttctacataagttcctcacattcaagtttgaagttccatgttcgatagatgctttaaagaaacgaagaaatggacaagcatggtgaccaaaattagaaaccagtgatctcacagaaaacagagtaccgttgaaatcatacttaaaacagatacaaaaacagaaataaaagcgtgaagcgaatagaaacggagttaccatatttggcctagtggtgcctttcgagcaagaagctggtgagagtaaaacatcttcaagccagtgagaaactcaactatctgcattcatcaaagtagcagagacttagtttatgttaaattcaaaaagatcaaagaaagaaagaaagaaagaagcgtttgaaaaagcaaaactcactactctctattcgcttcgccttgcaaaactgtcaacccgccaaatgcaatatgtaatggcaatgcagcaagcaacaaacaaacacgccaatggtaacgaacgatgtagcaaaataagagctacccgagggtgcaccaaatcttccagtgccacaaagcatgactataacacgtgtcaatggcgtgacaatgtataatagtgtagtaggagtaggagtagtgtagttttagcgcactcttggctggctgttagggtaggctgcgcataatcaaagatttttttttctttcattctttccgtcatggtgaggacaatgatgtgttacattaatatagttgtcttattgatttactttttatcaaatttgaattattctatttatttatatatgtaatgataaagttatttacaatattcttcttcctagttaaaacggccgagttcggtgctaacacgtccgggtccactcaccccgagtcaatcaactcgtggttcgcctctcgccggtacgggttcaagactctggacatcaagctcaaggtggccttcgtgggcccactccttctcaacgacgccatcacgcacggagatttagacgcgtttaggaacttgattgaacgacagcgttccatgctcgcagatttgtcaccctcccaagccgagtcgctcctcggcgccgccaccaagctgctcaaccaggacgacatggttcacctcctcttcgaagccggcttgtgagaataatcgccaaccccaataatgcccctgatcaagtacacgtggcagatacagtacaaatacaaacataaatgtaagtcaatcccaagcccaaattaataggcctatcagacgattagacgtagtgtattgttgcttctctctaggattgatggaagtgtctaagatctgacatggagagttatcatcttttaacttacattagttggcatccatttattgttctatctcaataaaaattgatgacattttgttaaattttgttttattgaatgccaagcaatgcttcattttgatttatgcatgacttaaacctgtacattacatatgttatgcgagtagtagtagttttttaatgcttacttcatttttattgatttgctgatttttgtttgtttgttttacactagacattaccagcaattcaatggggaaagcataccagggttgttattgatgttggctctggtgttgctaactttggtggttatatgagctcaataggatcttagacctggcggtttctttgcatggtctgcaacaccagtttaccctgatgatgaaagagatcagaaagtatggaatggtttgtccttctctctttttctcttacctcaattgagtctatttatgtcattgtctctccttcctctgtagttaaaaatcctcaatctgtgttgagcatgtataaatttaattaatttaatacatggagatgttgaatttctgtatgacccaatcatggtgctgcaaacaaatttgctctgtcttcgctcttatgtttaagaaaaatgtattttttttttttttcaaactgcagccatgtgctggaaggttgtggctaaggctagtgattcttctggaattggacttgttatatacccgaagccagccttatcttgctacgagaaatgtaaagagaacaatcctcctttatgtgaaaataaagaatgggaagaatagctcatggtattttatatctctcgcgtcttatttctatgatgtttatatttccatcaattatattttctccacaataccaacatgaaagaaatgaatattgtcccttaaaaaatgccatagataatgtgcatgtattgcaagcaatgctatatattactgttttgtctaatttccacctttgcttattttgtttgcatgcttgtatttaggtatgccagactcaatagttatctcactcctcttccggttgatggtatgggtaacctgcagagctggtccaagccttggccccagaggcttaccagtaagcaaccaaggttacctactgattcagatgccaaggacaagttcagacgtttatgtgaatggtctttcaatgtcaagtgttcaaaatgtaatggacatgaatgctggttatacaaggtaaagtaattttgttattgattttctttactcactttttcctttacattctttatggtagaatatggaccattttgagggcatcggtagtatttacccatatacttgatctgtttttcagacctacatatggttcaaattcaataattgcatgtcaatcttctgtgccatgtacatttacattatctgttattgcatcaacataaattgaccagtttcctccaagtttctttctttgaaactgataccgactctgttatttccagatttgccgctgctctcattgatctaccagtctgggtggtgattgtagtacctattgatgtgacagatactctgttagtggaaacaatccgaaggtgatgaatgtgtagggatcttcttaaattttgctgtgctataatagttttttgtaaaacctttttttaacggatttaaaagcatataacacagtactagtttattaacttttggacattttttaaaagagctggattagtcttgaaaattatatagcatggtcattgttatttttttagaaaatagctaaattgacctttgaatagatgcgacattatagcacaagtcatattaatccctaaaaaatatagaaataatcacataagttcacgaaatgtgtattttgtgaactaaattactgcttgtttgattcaccttttgaagcaaagtttccaattatgtcattttcatcacttaacattgtgcttaaaaagaatacgtgaaagttgcccatgttgaattgcattgctctattacaattgattgttaaaggagttataaggcttgctcctggtggttgaaggaagaaggaatgaggaagatgtcatgagtatcatttccaccaagaatggatccaaaaatattttataatggaggcaaaaaatgccagtttgtaatattttcaaagaaaaatatcaattttaaatttttacaaaatatataatctcatggtaaaaaaaattaaattatttaagcatctagaaattacaattggatcaatgtgtgtgtttatgtcacttatttgtttaaaagataaaataataaaattagtatcaatttattgtctcttttatctcttataattatttatatttatttgtaaaaacagtttaatattatgggggcaatatttgttttttatggggataaaaaaattatcagataagaaaaaaatattttagtgggggcaattgctcccatgaaaaggtggatctgtccttgatttttactaatgaaaattaacaattaacattaatcaataaaaaaagagtattgctaaatatcatctaatatgttctaaagataaatttgatctttagtttcaaatgatagcttatgtgtttaaaaattaatttaaactcacatcccattatatataagcaaacttatgtgtttaaaattaatctaaacttacattccattatatataagcattgttctctccaaattctttttgtacaagttgtcttacttctcgcatgctctgatctccttctttatccgagatgttcgagttagtctttgtttgagatatctagagtgtattgttgtgatactatgattttgatactatcaaattatcccccgtttaggatgagtgagttattgtatctcccaaccctctcagtcagcatttgggagggtcctgtttcagctttatgatatttggtattttcggacgtcgatcgttggcgtcaccgttgacccgcctcatggtatgcaacattcgatccttaaccgcttagtagttttaagagaaattcttaggtatacttggagtaagatatttttgttgctttgatttatttattgttcatcatgtcagcattgtgagtcattgttgttttctaaattaatgataatttttaatttttctagatagattaatgataatttttaatttttctaaatagattgctgacatggtgaataatgaatggatcagagcaataaaatacttattctaggtgcacctaaaaatttctcgtagttttaatcacgtgcaatatgtgcctaggaatatggggataatggatgagatcgtgtataataaaccttggcgagaatattgattgattaactattatgcgttcgtatataagcactaacacttgacttaatgagacagcttgattttgacacaaaacacttaaatattctttaactagatcttttttctctaagacacaatccaactataaagacacttatcagatagataactttcctaaaccatttgttatttagaactgccattgatacaaagtcttttttcatatatgcataaaacacaaacatcacatgcattgcacattgaaatgaaaatacttttaattcaatataaacaactatacctctgaattttatgaaaattgatgaaccagccacatcaataataatatcaaggcaatcataataattaagataaaatatgttttaattctttaatttgtggttaaaattgaaattagcccaatagccttaaaaatgattttagtttttttattttttataattaatgaattccattcctagtctaacattttaagttctgtaaaaagagatagaattttctaattataaaattatgagactcaaaatcgtcattttaaaattaaaaaaaatactaaaaagagataaaattttataattacaacccattagcatcagcctgatatatcatggtcatggattcaaatgttagtgtgaccattatacaatgtataaaataataacaattttaacagaatatctcaaagaaaaaaacaattttaacagaaatttgactaacacacgttttaccctaataattacaataagtaataatcctagcgtcagttgtttgttggtgtccatttttcttatcctttttggtcagattcctcctgcataaatcagggtttggtcttcggcttttgcagaatgtgagacacgacatgacattgttctaacgttgacattaaaaccttaacaagttcggagacagcgtttaaccacagtaatctcacaattaaagtcaccataaatgtaattttctttaattaaaatttatgttttactatataatagcacgaaccttcgttgtatttcgtaagatcctgctaaacaaaacaaagcacaacgctgccattgtcagtgtcaacgcgtcggttcgaaagtttgagaacctaggattgagttgaagctgcgttctgaatacagtatctgaccaccaaagtacagagtctttaggatccgaaggacaaccacaagatccagttattccttcttcctcgtaaacccgtgtgtatctctatgtttgtctcccttgagcagagtgaaaaaacaaaatggcaattttagctgaagacttcttcaaggagagaaaataccctttcattctcactctcttaatcttgctcatttgcgtcacgctcttcctcttcagcttcaaccacaccacctcaaacgctgttgctttctattctgttatccaagagaaaccaccccttaacccttcccaagcatctgctgattatactgcaaatccaaaagagcaagagcttccaccaaacatgaccaatgtgaggttcgattggaagctatgtgaggaaccgcagaatattgattttattccctgtttggataattttaaggcgattaaggctcttaagtcgagaaggcacatggagcacagggaaaggcattgtcctgagacaagtctgcattgtttgcttccccttcccaaaggctataaagccccagttccatggcccaagagcagggacaaggtgagattgatgagaattgaataggttttgctttatgatatgtcacataccaatttcttcttacatacttatgaaaatggtgtgttgattgttattagttaagtattctaagttttacttttatctagtcttgaaatcagtggagaaggaaaccttttattttttatttattttttcagatttggtatgataacgtcccttattcaaagctggtggagtacaagaaagaccaacactgggtagtgaagtctgggaaatatctggtctttccaggtggcggtactcagttcaaagatggggttgatcattatattaagttcatagagaaggtatgctgtcatctggattcacataatttagtaccataattatgatacacgctttaagcctttaatcttttattctccatgtgactgttatagttactgagaaactgtaatcaactactaaaaaagagccgaaaaatgaaaataaaaaataaaataaaattcggaggacatggagagtactgagaaggaacctgactactgtttggatcttgcttggcctacatattgatattatatgaacacatcaaaaaagctcagggattataattaggaatgttaggcaggagcagtaggtatatattctgatagaatactgaggctgaattttttttgcttagtgctgttagacgtagtgctttgttgcttctctctaggattgatggaagtgtctaagatctcagataaagagttggcattttttaacttacagtagttggcatccatttattgttttatccaataaaaaatgatgacattttgttaaattttattttaatgagtgccaaacaatgtttcattttgatttatgtatgacttaaaccagtacattacatatgttatactcgaaggactaatttttgaatgcttacttcatcttgtggtttgctgattatttttttttgttttttgttttacactagacattacctgcaattaagtggggaaagcatatcagggttgttctagatgttggctgtggtgttgctagctttggtggctatctgctggacaaaaatgttattactatgtcatttgccccaaaagatgaacatgaagctcagatacaatttgctttggaacgaggaattccggcaactctttctgtcattggaacacaaaagttgacttttcctgataatgggtttgatttgatccattgtgcgcgatgcagggttcactgggatgcagatggtacttatcttcttttcttgtttccatcaagatggggttctataattgccttccatgttccatttatattgatctctgagaaatgtttattcacaaatctgatcacaactttaggtgggaagcccttatatgagctcaataggattcttagaccaggcggtttctttgcatggtctgcaacaccagtttaccgtgatgatgaaagagatcagaaagtatggaatggtttgtctttctcttttactctcacctcaaccctgtctatttatgtcaatgtctctccttcctttgtagttaaaaatctttcatctgtgttgagaatgtatcttattgaatacatggagatgttgaatttctgtatgaccctgtcataatgctccaaacaaatttgttctgtcttcttatgtttaagaaaaataatttctttttcaaactgcagccatggtggatataacaaaatccatgtgctggaaggttgtggctaagggtcgtgattcatctggaattggacttgttatataccaaaagccaacctcatcttcttgctatgagaaacgtgaagagaagaatcctcctttatgtgaaaataaggatggcaagaatagctcatggtattttgtctcttctcgggattttatttatatgatatttatatttcctcctgtttatactttctccacaatgcctgaaagaaatgaatattgtccctacaaaaaggccatagaaaatgtgcatggaccatagaaagcaatgctagatattactatgtttagtctaatttctaccttcgcttattttctttgcatgcttatatttaggtatgccagactggatagttgtcttactcctcttccggtggatggtatgggtaacctgcagagctggcccaagccttggccccagaggcttaccagtaagccacctagcttacctactgattcagatgccaaggacaagttcttcaaagacagcaaacgatggtctgaattagtttcagacttttatatgaatggtctttcaataaagtggtcaagtgttcgaaatgtaatggacatgaatgcgggttatgcagggtaaagtaattttgttaattttttttgctcttttcccttttattatattctttatagtagaatatgggcaattttgagggcattggtagtatttactcatatacttgatctgtctttcagacctacatatgaatcaataatggcatgtcaatcgtctgtggcattcaataaattggctggcttcctccaagcaactttgaaactgataccaagtctgttatttgcagatttgccacagctctcattgatctaccagtctgggtgatgaatgtagtaccgattgatgtgccagatactctttctattataatggacagagggttaataggaatgtatcatgattggtgcgagtcctttaacacctatcctcgcacatacgatcttcttcattctagctttcttttcaaatatcttgagcaaaggtatgcttattgaggaaactaatacctataagatcacgtgatttctccttttatttattgttttagaactctctcgacttacttctacacgtagcataggtatttgttaagagacatatctgataatgaacatttttttggtcagatgtgacattctagatgtggctgtggagattgatcgcatattgagaccaaatggatatcttgtggttcaagattctatggaaatacttaacaagctcattccaatcttgcgttcacttcactggtctgtaacgttgcatcaaaatcagtttcttgtaggtagaaaaggtttatggcgtcctacgagctcttgaaactgaatgtatatcaggttaataaaaatgacgtattcttcaatcacccatgtatcagtatattctggataaaaattaggtgtaaaaagaatgaattttaagaaaggaatatttattcgacaaggaaatcttgtctgagtgtgaagtatgttaacgagacatttattagaaatgttagttttttatctacaaatgttaattttttatttttatttaaaatgttagtagggggatttgaactcttcacttctctctcttctcttatatcttcttttttaatcattggactaatcttatatctcgtgaaaacttatgaatgatgcatttacctttaccataacttctgcatgcaatagttaaaagtagtttcgttcatgcacttgttagcacaagaaccaatttagcatgcagaacatgttacgaaaatgtcaatttttttactctattctttgttttcaaaagtatggatattttttttaaaaagcaaaataatttcattgatcaaaagtgaaagcttaacctccaaaacacaagccgtgttttaaagaacagctcctccccaaggtaatacagcttccagaagcttcaaagtttggatataaaatagtgaaaaacaaagtaaaactagaaaaatgaaaatagattttcattatttattttactaaatttattgtctattttcattttcttttttcattatttttgtacaaacttttgagaaatgagaaaaaagtaaaaatacaaatagattttcttaagccaacaatccttaggcttttgttatggacttgcatgaatggcctctaaggccacgaaaagcataattcttgaagctgaaaattgctcgtctgcaagctctactctgctacgagccatacatttatgatatgatctttgtttactaaccgtgggttcagtagcttgtgccttccttcagtgtctactgtctagatccaggcacagtggcacgtatggaaacaatacatacattatgcagattcaaaagatactatcatacagattccttcccctagaaaaaaaaaaaaaacctatgcaggaaactacataataaatagatgtacggaaaaaagaaactacaaagaattttcacaattcacagacaaaagttgaattgtccgcaacgaccctgccattagtcgcagcaacattccttgagtagcaagtgaacctatcaaaataactgtaattctgggaggtgcttgcttgacccgaaacaacagagtgacccttaacctcgatccacccctttgaattctgctcattactaatcgatttgacgaagcacccgctcacatgcttctcctttagagtgtgagaaagatcagtgacaagcctataagtcccatcctgaaactgcttagtgtttgtgacaacccttaaagggtacctcctcctaaccttcaacctagtaatcgattcgccttttccatcgatcaccttaaccttcttcttggccttgaacttctgcttaacggtcttgatactcccgttgtgttggaactttatggagttcttaaacgagaagccctgagaaacagtggtggtgatgttgcccacactagtcataacccaccctgtgatctgcgtttccttctctgcgtccacaccaaaggccccatcaagccctttaaagtcctcttgccgttcgattgaagtttcaggactgtgatgaaccacagggtttgcatgaaccaccgtggattcatgatccaaccaaagatgcaaatttgcgttcagaagccagtaagagattcccttcaccaccccaattccaaagacgtgctctttcccgtccaaaaccttccccaaaaacggcgtcaaatcgatgtcgtatgagggaaggtcaaaggccccaatcgccaccattggttcccagaacagagggtttatcccgccggcgaagatcaccggaaacggaatctcccatccaacaacctggccgtcgatcgtcacgtacacttccctgtacgcgccgttaccgcgctccgtttctaaaccgttcgccgcgatgtacgaattcggcgggttggagtaccaaaactcgtcgtttccgtggaaagaaacgtataactcaagcaccgcgcggtaagtgttcatcggaattcgaattctccgggaaccagaacctttttcttcctccaatttgaaccagaaccctcgccgtccgtcgtcggagatcggaataatcaaatcagccggcgattcgttcacgcctctggagcccggttcctgaacaagagatcgagatcgtgatctcgattgaattggatcaaaattgagtgcctcggggcacgggacaaacggaaccctaacgggagctctaacggcgtacttgttgtagaacaaaagagtgacggtgacgtggtagacaccggtgaatttgttattgacaatgttttcgagcatcatggtgaggtcttggttgggcttggcgaggagggcggagtatttggtgacgtccttgtggacgttccagaagatgccggcggggctgggctcggcggtgctggtgcggaggatctcggcgccggcgagccagatggcggcaatgcggtcgtactgctcgcccttgcaccgcgcgtggaagtggaggaccacccgagaccacggtgccccgcaccgcgggggcggtgtgtaagaggtggtgtacggtggagaatcgatggtgttggcgaaggcgtggtggattattcggtgggtgcatgaaggtgttatgggttcgtgtgagtttggagggtaactcacttcgaagtattcttggtgagaaccactaaggggtttgcgtctcatgaaatggtctggttgggactctgataaggttgtcatcaagaggaagagtatggagcagaggaaggtggtggtcatcttgttgtttgttgtgttgtgttgaacaatggcacactgtaacacttttttttttcaataactaaataactaacctcttaagatgattcatggttaggaaatcatattcaaacgtgaaatgaagctgaattcgggttaaaaccctggagaactttggatactgggtagattgcttaatttacaatttgattaaaaatggcattatatatataatggagttcggtactacaaaataaggaaatttcttggtcgtgtttttcttatcagcatcctacccaaagtaaactccgcgtgcacttcttccattccattgcaagtgttgccacatcaaaaataacaaactaaacttcaattatgaaaattgaccttatttaattgctctacttttatgtcataataatagtaaagtgataaagatgatttttattattttttcggccaaaaaatgtagaagagtgggtaaattttatacactcaaaggtaattcaggaaaactgtgaaagtgccaatgaccttaacaaacagataaaacagagacaatagtttgagtgtaaagtattggacacacatttccaattccagagatctttttagtcgctcgtgtataacgaaagcatattgacactgtcatacaaattagagattgaaaagattaaccaccacccgccccaaaataataaaggttgtgctttccatttgcttctccactctaccaaaaaaatttggtcaatctgtgatctcaaaaccctggttcttctacacatcaatgtcccctattcttatcttcttcctcacaatcttcaccaccacttaccaccgcattgtcttggcatagctttgtcatgtgttcggcaagcaaaatatcaccatgttcactcacctgaatcacaatgtagtgccaaaaccatcaaatcaaccaaaaaaaaaagaagtataattctactctaaatctgcactatattaaaagatagaagaaagcatggcagatggagtattagtgtattggcaaaacatatagagaatgtcgtaaaatgatatatattagaatttagaaaaccaaaattcagtcaaatatagaaaatattgacaccctgctcttggcgcatccttcacaagtttacccttgtcagttgtgttgttctattgacgcaaacagaagcaacattgttgacaacaagtattccttgcaactgtccagaccatatcaaaaagttactgcttacacttttagatgcaattctacaagactacaactgccttacttctacttgatagtggataagatatgagatttaggtgggaaagagaaaggagggaagaagcacaaaacataacagaatgatagagagagacagacatcaaagaactgagtattccaatctttctaaaatacaacagtcatgctttagttttaggcagctacccaacatatatcaaaatcctaactaacagtacctgactaactaacattattttcttgtttatttttacataacaagatactggatattgtctagtctgaagtatctactactctactgtcttaacagttggattgtcagaagggagatatcttctaataacaagtgcaattacaatctctgcaaaggtggcatttgcttaagtaaccacaacttttaaagttatcagcatagcctgcataggacatgaatgatatattttttggtctagtacaaataaatattcagtagcagataccaagagtttacctaccatatcaaccacatcctccatgttagtcaccgagtgagagatagctgtaggttgcgggtacatctgatacttgattagttggtaggataaacagacacctttaagtagtattcagaaacacaaacatccatatgtttgacttctgaaatgtatacccccttagattttttactttgatcacttttgaaaaccagcaaatactactaatagtaatttgtaacacaattattaagggatataaaaggcaaatcaggaacctctaagtacaaagtgcactttagacagtagtagagtacgggggggggnnnnnnnnnnnnnnnnnnnnnnnnnnnnnnnnnnntctaaaatactcttttcatctttgttaaatgttaatcaaattaataataagggtatttaaatgaaaaattgatagataggagtggcaacagacacatgaaaggggcaatggacactcccaaaacaagttataaattctcattagaaaatccagagtaaattcccaaaagtctatgactttgtttatttatccatgtgcttgcattagatgttataaaaatgtttttttctgaatgcaagatgttataaagagctaaagcagtccgatagaagtcagtggctttgattgtttaatggagctgacaccacctaataggatagttagtagtagcacttgtatttattttcccatcaatttccgccaagttagggtttagcaggcaaagagaaaaaacgaaacgcaaaagcttgacaaaaaaatgtcgcatccatgtcgcccaaggtaaggattagaggggaaaatgatcataaaaaaaatcgcccaccgtggggctcgaacccacgaccacaaggttaagagccttgcgctctaccaactgagctagacgggcttcttacaataagttttttattatttgtaatactatttatgtttcacttgaagatatagtttaacggatgtagttcgtttgggtaaaggaataaattttttattttattttatatatcttcattttttttcaatgtttttatgtttcataatgttggaaagaaaatcctttgcacacacactcacatatatgaacaagagataaatttcaaaaaaaacttgtatatttttttctcttgcatttacacatgtacctcttatatagtgttttttatctcaaagttaattacaatataaatatcaaaattaattatcatttaataatctaattaattcctaattgtgttctacttatatttggattaaaactcaacactcatccttaattcaaatcattacaagatacaatttccaacttccttctcagttttacaaatctatcaggcctaattgtcttaattagtatgtcagctgaatttctgttgagcgtatgtcacttcaagttttccattattcacatacttccttagaaaatgaaatatgattttaatgtacttatttttcccatgtgagactggatttttagttaaattgatggctgatttgttatcaattatcaatttaatatgtttttctacttcaaatttcaattcatctagcaatgaatttagccaaatagtttggcaagcagcatatgagcttgctatatattcaacctcacaagaagaaaagaccaccataggttgtttcttagaacaaactgaatgttgacaactaaacacgagggttgtgggacttagcccaacaccttaaagcacgagttgacgacaaccatgcaccacctctttcaagagaattcacgccaagaaattggagcacctataaacttgaacaaatatccaatagtgagaatagtatatataacaattgtcttgattaaatgaccatttttttacaacggataagaggtatttaaaatttcttatttgatacttaactaattttcaccccatcgaattagactatttttggataaaataataccttagatgtgacttcgtgtctaaatgaaggatttttctattaaaattttaataacaaagaaaaagtcactagcaatggcctattatacataataatgtcaatctcaccaattttacaattttgaaagaataaaaaccaaaataacctaaataagaaatacttaatgtagtttaattattaaatttgtttgctctaaaataagggttttttttttccgaaagaataaaataagggttaaatctagacaataaaacatttttataattattcattaaaaaaagttgcaattaaaatttgaatttcattatttattatacatatacacatattttttgacaattttaattactaatttgaaaacaataatcataaacatatacttatcctaaaccaaatgataacattggcaaaaactgtattaatgaaagcgtaatctcattattggtataggccccatagttatagtttatgactcgaatgtgatcaatttaaaaaaaaaaaaaaaacactcaaatgtgactcaaatgggcatttgtcttctgacaaagaaaaggaatatgggcctttaaggaccatgatccagcacttctaaggattagggtttcttttcatcaacctctcaccttaagtgccgcagcaactcattctgtttcttcagtttggtataactttagccgaggtccagaggagtactagctaggttcacaattttaaaatggttcgtattcttacatttcttctgattttgatgcattctcaagtttatcttcataataggtttcgatcttcatcgtcctttgagcattttactccaattaaatcttcattttttcatgaaatagcgcttggttttctgcaatcagagtgtcactatgtgtttacgcttcagatcacatgcttcaattcacgatatcatgactatttgtttgataatgaattcgtgcctttgaagagtctacatttggattctttagatttcactctgtgaaggatgcactgcattttttggatttagctggactaaacttgtgttttgtatataatttgttctttctgtttttttatccatctcgcggatccattgatactaccctagggttttgttcatttaatgttagacttgctgtttggatttttttttaatttgtgtttagagttttaaacttttgtgcttatgactgttacaggctagggggctaaagaagcatttgaaaaggctcaatgctcctaagcattggatgcttgacaaactgggtggtgcatttgtaagtggaaatttaatcattttttaaccagttttgaaggttattattttaaagactgatgaacctttttcatcctgtataggcgcctaaaccctcatctggaccacacaaatcgagggagtgcctccccctcattcttatcctgcgaaaccggctgaagtatgctctgacataccgtgaagtcattgctattctgatgcagcgacatgttcttgtcgatggcaaagtcaggactgacaagacttaccctgccggtttcatgggtatgtttgcagcttgtcaatttttagaataactgcctgtttcatgttatgtagccaaaatatgttacagtatgagggggtaataatatgctaaagttacttattgtttattgagcttgactaattctgaatctgatgtttttaacaaactctcttgaagtctaggtagctggatattttctatatatatatatatatatatatatatatccaggactttgaatggaaagttagatgttaactgattctcagcttttcatgttctaagaatatagtcttttcctctgtgagaattacagacattgtaaatgttaacccttatttctaacattctccagtggcgtgtgaattgactatggtaaaatgtgagcttgaatttagctaaccaaattagttgcagaaacaattcttggctgtcaggctatacttacctcctgtccgaactccggattagtcaggttgtcccattcccccgatgtattggagggttaagacaaaaaataatagttgcagaagcttccaccaggctctctcccccctctcccccgccgaaaacactttttgtctgtcccaatatgtttctatagttatattgatttagcccgaggaatgatttcttttttaattttatctctatacagatgttgtttcaatcccaaaaacaaatgagaacttccgcctgctctatgacactaaaggccgattccgtcttcattctgtcagggatgatgaggccaaggtactttttatatggtttatattgaatattgtgattcatttgcagcctaggtgctattatactattattatgtaataatacagtatataattgactgtagctttgctgtgtttagttatcttgtatggaggctaacaaatgtgttgatgctattgaaccttttaaatgtcaatttcaggatttgtatagttttttattttattttattttggagttacaatttttcctacttaatggttatggtttaacatatattctttatatgttgtgtaaatggcagttcaagctctgcaaggttaggtcagtgcagtttggccagaaaggtatcccatacctaaacacctatgatggtcgcaccatccgttacccagaccctctcatcagggccaatgacaccgttaagctggatctggaggaaaacaagattgtcgattttatcaaatttgatgttgggaatgtagttatggtaacaggtggaagaaacagggggcgtgttggagtgatcaagaacagggagaagcataagggtagcttcgagacaattcacgtgcaggattccactgggcacgaatttgctactcgtatgggcaatgtgttcactattggcaaggggacaaagccatggatatcactgcccaagggtaagggtattaagctatcaatcattgaagaagctaggaaaaggattgccgcccagcaagcaactgctgcctaaaccccttttggacgaatagacttgagtgcttggtagttttattcaatgtttttgttttctaatttcttttgtctaagtttttaatcgttgaattttgactcttgcactatacaactttattgtggctgtgttatcttcatgaagtaatctttctattccctagttttttacttggtttttggtcgtcgtacaaaatcactgaatcaattgcaccataacaaaatgccgtgccgcagctgtagtaagatggtatttagcgatgtttacgggtacgggtcatctgtaaatccgaattgatccgaactgtttgggttggattatttatgtgtttgggtcaaaatcaaattgaaccaatcaaaattgatcatgtatggattcggtcatggatttagatttataaatccgttgactcgtttatccgatccgtgaactcgtaataataatataaattttattatatatatatatatatgtatatattaaaaattaatttttttctctcgtttagcatataactcaattaatttattttttttttgtaaaaaaattaatagaaataacattttatttgttattgtatttggacagaattatgaataatgttaggcagtagtaacattgtagcacaacaaattttttatagttttggttttttaaaataaataatattaagcttaactcaatcagaaactgattcaacaatatgaactagaacatcccattttttatactagtagcaattaagttaattatagtacattggcttcaaacatgtctcataacataatgatgacaaaggtgataaggatcagattgagatgatgaatttagaatgaaaatcaagaaaaaacagggtgaggtgcaaaaaaatgagttagataggtatttggaggatgatgttgaagctgatcaccttgagtttgatattttgaattggtggaaattgaaggcattcaaatattatattttttcctatatggctagagatatattggtcattcttgtatctactttattatctgagtctgcatttagtataggagataaaattttatattcatttcgtagttccttgagtcctaatactgttgaagctctcacttgtgtccaaaattggattagatctactaagcaaaatgttaatgacttgcaagttgaaataaatgaaacggaaaagattgaatcaggtgtgtaatcccttattttattttttatatttgtataaaatatcaattaatttttgcactaacgatgggattgtgtttaaatttttagagttgtttggcttgactttaaatattgctaatattaggtctccaagtattgaatatgcaagtgttggaacttcttaatgtattactttcaggtatattattatttgtttcacctttgttttcatattttgtttaccgtgtttataatattaatgaatcatattttattcatttgtttgtttcagcaaatctagttacaacaaatttggttataacaaagcttagtttgtaagaaatagttatgattcagactattatagtaaatcttattcaagaatcttttgttttaatttatattataagtctattttagaatattatgttgatgatattaaatgaatcaattttactactttcatacatttgataatattgtgttaattgtattggatatttgaaagaatcatgatataaaatagtagttctatgaaaaaaattaaatggataacccgttgaaccgaaccgaaccgatcatgaacgggttgggttgggttgggttttaattattttttttttctgaaaatcaaacctatcaaatttgattgggttgagtcctaaatttggtcaaaatcgatccaaaccgacccacgaatacccctaatggtattgcttgctattgaagagaatatggatgtttatttgcgtgttttagtaatgattcaatgcacctcattgtttgaaggagttcttttaaattgttgatttgttgtccgacttaaaaggaaatgctattaacacatttttaacatattcttttgatttgaacacattctcgacatttgcttttttagtccctctccttgtatgtgtcaaactaaaaatattgaatatgcaatttcatcgacctttggttgttagaatttgatttttaaaattctaaaattaaattctggtggtcaaccaccataatttttaatttttgtgtaagccgcaagtgaataagcatttcataagtttgaatgattaagaaaaataattttaatttgagggattaaaaatatttataataagaaacgaaaagcatatttaagtgacttagcctcctcaaatatctaatgaacgaatacatgtcaataagtttataatacaatgggggatgtcgcttgcacttccactattgtttcctacattgtcaatgtattatggaaagctaattcaaaatataacgggataatgtagaaagcaatagtgggagtgtatagcataaagggtttttgtccctaatattcattaaaaaaaagtgcagaggagttgggtctcgttagttaattttgggtcaaactgatttgggtcttgagttacttcaaaatgtagtcactcaaaaattaaggttaaaattgaaattaaaaaaataaaaaataaacagcaccgtcaatattgcccttataaaaaaattgccaatactacacaaaatttacacaacaaaaaataaataatctcaataaaataataaaaatgaacattgaatttaattatataattgtgatgaacataaaaaacatagatatcctgtctaatcagccaactgcaaccttttattatcattattataaaaactgttatattataaatgagaagatatcaaattatattggtgtaattttgataattattacataattttataattttcaactgaataatattttcttaaaattcattattgattaaaagttcttttcacttatcatatatgcaaaatttcatattattctaaaattatttattaccttatttatataaattaaaattgacttaatataagcatttcaaaatatactaaaatatggatcatttgattaccttattgttcaattttgataaaatttggcacaaataattttggtaacatgtagatataatttaacggttgaattaataaaaatcacattttattataactttgcaatttatgctcttaatcaccaaatatcgttgcttagccttattgcatccctagccatagataaacttattatttagttatgggtcaacttgcaatataaatgcatgcatatttgctggtgtagggatttctatttgttttagcatcttctatgatgagaagggagagtaattaataaaataaaataaaagtttcctgctatttatttttggggtgttagaccatcatcttttcttgtttatgtaccacatgtttattgagataggttttgccttctttttttctgaatacccagttctaaatagaggaatgtttaggaaagactgagccacatgtgttttgtctaatttgcctttgcaatgttgaacaaacaccatctctcacaacttccatgagcagcaaccatttgaatcactgagattgcaccatgaccaaaaccgtagctagcactttcttgccttccaggcttccagcccttgagtcctgcacactgagacgcaccatggctcagattccacacgccaaaaacatgagccaatcacccttcaaggagtaacttattatgcttcactcatttacggagcaaaacattaaactatttaaaaatatttaaataaaagaagcatgtttatttctttacaaggagggaaataataatcacttgagtcacttctgtatgccttgaaagagttagtttccgactatcaattacgaaaatattaaataaaataatatttgcattttaaagtaataaccttatttctaaaataatatcattataatatcgaattttcttgcaatgttgcgtggacaaaagtaattaattactttttaacaaaaataatcaatatattaattatttcattgacaataatgatagtgatgacaatgacaaaaataataaataaagatgatgacgcttgttagaaataatggtgataatagtaatgataataatgatagtaaagatcaaaacggtattattttatgtgttgaaggagagattaaaagaagtgaatctattaaataaataagaaatgaataattttttatttgaaaaaatcattaccaattaatatatttatcttttttataaaaacaagtaattaattactctattgtgtacaacattggacacgttagatagaccattattataatttagacaaaaaaaaatgttttcatttatttcatataaaggagtgaagataatattttctcatttcaaggattttnnnnnnnnnnnnnnnnnnnnnnnnnnaaaatatttccttaaatattagatatataatataataaaatgtaattaaatattttcttattttaagggtcttgttaatgaacaccgtaacaatatttcctttaatattagagtaacatgtaattaacgatttatgatagtatatgttaattacttatttgatatatagtatcaatatattcattctaaattatataatgttttataaagaatcaaattagtatttttttattttacaatttagcattaattcgtacgtccttccgttttgatctatacaaatacaaattgaaattcatattgaaagtataatatagaatataatgaattatgtaatgaatcaccataaaaggaaataattatgtaacgtgagcaatgctataaagaattcaacaaccttacgtctcgtacggaatggtttctcttttttttttttgaaaaaaaataatttaagaatcaaaattaattttaattttgagtttcaatttattctttgtttttaattttttttaaaaatgttacaaattgaagataaataaaatgagtcaaccattttatcttatatcgctctattatgaaataatgatggtgacgagataactggatgagaatggtggtgataacactggtggtttaggtggtggggtggaataatggaggcaacggtggtggtgaaatggtgatgatcatgatagtagtaatgaaatggtgatgatcgagttttaaaacccagatagacccaactagtcgaactggtttgactgcgatcgaaggtctagtcgggtcgagttgcatatcggatcgatcatgcattgatgaacatggtgcaacctggaatgacccgaccaactttgtggttaaatcgatgacccacttaccagatcgggtctcccccaagggaggaaacatgctcgatcatccgggtcaattaagattgggtataaaattataacttttttttaataaagaacaggtcaggtaggtcagttagtgacctcataccttgactaagtcaattaccggttcagattttaaaattggggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcgatagtagtgctggaatggtggtggtggggtggaatagtggtagcggtggcgataacaacaatggaggtgacaaaacggtgccaacaacgacagcgatggaatgatgcgatggtggtggaggcgacaaaggcgaggtgcgatggcaattgttgtggaatggtggagacaatagtagtggtggtgacagcgatgtcgtggtgctgaaggcaacaacaacagggtgtggtagcagtggcgatgatcgtggtgaaatggtggtgatatagtgatggtggttagaatgtgtattttaaaactaaaaatcaaattcataaaatcttttttttcttggttttgataatgaatatgaaactgttttgaaattgagttaaaaatcaattcaacctcccttttggcaaacatattttgttttgaaaatcgaaaatcagaaactcgcaaccacatcgaaagaggccttaaagaattaatttactccctctcattgcaaccaagagcccttgattaagggtggctttctttgtttaatttttttaaaaataatcactttaataataaacagaaaggatttgtttcttaaaataagaaaaaaatcattttttaaagtaatttttttttagataaacacactaaaaaattgtttattttgttaaattaaacacttatttcaccaaataagtttaaataaactaaccttaaaattccccaccataaaatgaattctttaacactattttcctttttgcgcaccctttgcttgatcctcattactcaatctccttccttcgctaacaaatgctagaattcatggtcatcaatcataggctgctcggtaatggttctcacctaattggcaaaatttgcacgacgaaacaagggaatgaaaggccgctttgcgttgaatgctctagaccctgcccacaatgatggctgatcctagagttctgcatgcaaaaaactttcttgaactttcagaggcggtcttgaagttggccttaaagaagggaatataaaggcagaagtttcttaagggatattggtgaagacaaaataagttccagccattgcagaatgtgcaaactctgactatgaatatgtggttatggcgtttaggagtgttctgagtgagttgatatacgaccctctaactgctatctttgctaacaatgatgccaaacatgctgctcatggacctgaatactgtgagacagccttgactgttgtacatattgttaaccctgcaatttctattcttaaccactaaatatcgttgcttagctttattgcattcctagccataaatcaacttgctatttaaggcaatttacttatgggtcaacttgcaacgtaaatgcatccatatttgcaattgcaggttcgaccaaagtgtagggatttctatttgttttagcttctcaccaagggagagtaattaataaaatcggatataagttttctgctatttgtttttggggtgttgactatcatctattattgtctatatatgacattatgtttattgagataggttttgtcttcgttttctttttttggaatccccaattttatgtggctaatatatacaaatgaatgaaataaaaacgattaagtgaatgaacgaaataagaatatgataaggtcccatagaaggggataaaaagggaaatatctcaggaaggttttagaaggaatgagtcacgtgtttcgttcacattagttattttttaaaggccccattagtaacctccatatccagcaccgtctcactacttctatgctcaaccaaagaaccccacaccaaccactgctccttgctcactgagacgcaccatggctcagactccaaagctaaaaacataaaccaagcaccaaaggtccatcctgtggctgtgttcttgttcttttgacactccgtgctttatcatttgtctgtccatctatcattttgccattgcattatttggtgttatgagttttgtttctcagttagaggcttagaggatcgtctcttttcactatgttttgtaactaactaatcttttatctttaatgtttggttctggccctgccatcttcgtttattttcatgattgatggaagtttgaatatccgcgttcgttaacctagccctagtagccttagggtgcatttaaaaggatagatttaagtgtctaccttttctttttatgaaaaaaaaaaaaaaaatcaacattgatcaagtagtaaataatctccgaaaggaccgaaaccagtccacacatttattttagtcatccatatagttcagttcccccttctagcaaaagacttgaaagccacctagttgagcaagatacaaaataatagaaagggcgtaatatagtaataatcatcaagctgcatctcctccctcgtggaggagcatctgatcaaagtgccaaacacctgaaagtccatcaaggaaaacacgtaacatgaataccttcctttgatcaaagcaaaaacctcaggaaaaaatagaaggacacgtaacagaattagaaattcttaccatgtcctttgccaactcttctgagctgagcaacatactctgatattcttttgatagcttccacctaagaaagaaaccattcaacaatagtgttattgaacttcttagcagtcttttgccaaatgcaatgcatagcacacaatatgtacaatctctcacacatgaaaattgatagttgcgtcaagaaatttatattatacctgttcacccagatactcagtttccacaaagtcagccaactgcacgtcacctttctttgtggcaacctgtcaaacaacatacatcaagtttaaagcaaggaacttccatttttaacaatatcaatgtcaagacgattgataccaatgaaacaaagaacatgcagcaaaaccaaaactaagatcctacaaaggtggcttacactgtgcaagttaaggagcttttcgttcgttagcttctctaatgacagagcgagttccattgctgaaagagagggaaaaataattaactctgacatatagagaatccagttgagaatttcaacaggtaaagcctaaagaagcgatttttttttcttgcactagttgacttctttatttgtattttgccattttggtaatataaagttatatatcagtactatataaatgtaacattcagtcaggatttgatttattttacataaacattatacgtaatgttaaactaggaattgaaaaaagaacttgaccgtaagtcccacaaaacaaaaatcacagctaagtatgttgagcttctatttcagaagaataagaggcgagcaataatatgagtgattgagtgagactgcataaaatccttgtttcatatgaatgaaaacagagtagtttgcttttctcagtgctccttcaattcatttccatttaataagtcactactcatttaacttttcaattcctatgatgataatttatgagagtatcccaacattcattcatgtactgcatgattccaaatcatttgtgattcatcacaagatactaagaatagtatcaaatcatgtcatcattcaaagattctaaaaactaggaattccaattctagaaacgatgtcaaaactgtaagatttcaaagctcgatcaagtatcttcaataatcaaaaccacaaagcactacgatgcggaaaaaaaaggttcgatccagaaaccaaatcacacagataacacacttcagatttagataacagaaaatgaaatcaaacctatttccaattaacacacgaactaaactgaaaacactaaaaagggaaatcacaaggccagaaatactaaccgtgcagcgcatctcccttatctgcatgatcaaaatcagaaagcggcatcacaattgactgcaacttcacttttccaccacgtttgttctgaaaacaaataaacaaacaaataatcagaattcaacgtcaacatcactcgattccttatacgaaaaaataagtctaagtcaaacacctgatactccatcaatttctcagcatgctctctttcttcttcactcgattccttaaaaaaccttcatcaaccacacataaccattattaataactaataatcactcctaactagtataaaataaaacgataaattctaaaaataacgaaacggttacttacttggcaagtcctctcagcgcaacgttgtccctatcgaagtacgcaaacatggcatggtaaacgtacgaaacgttatactccacactgcataaaataataataataatcagaaggtgaaaaaagaaaatgaaataaaaccgatgagagagagagaaataggagcaacttgatttgttcgttaacggcggactcggattcgtcaacatatttttggcgagcgagagaagcttgtggtacagtgggaacgaggtcgagctccttcttcacctcttcgaacggttcaaaaatcactccggttagggcgcggtggttcgtggatcctttcgccgcgcgaaccaccaatccacgagcggaaaccgaacggggaggttcggcgttcggactgaagagggagagggacgaagcagaagcagaagcagcagcagcggttcggagaagcatggtttctggttcgggatttccacgaagcggtagatttgaaaggaaaagaaaacagaggaaaacggaacggaacggtgacagtgtgttattgtgagcgtgtggatagagatgggtctgtggctgtgtgggactaaaaggaggggttggtgatgtgggagccgttggatggggtgaaacgtggaaggttgagatgtaaaggtggggctgggcgcgtggcgtgctcgtggtctagctgggtatcattgacgtgttgtccttgtcccatcaaatatctagaatcctttatctttaaaattattcttttctgggtccaattacactattttaagtggaaccttttgttaggttgccttttttccagttgtattttcccattaggggacgaaaagagcatgtacataaaaaataatgactcatgtgcgaattaatataaaagagatttgttaattataatttgtcaaatgctcaagatattgattaagaaagtaaaagataatttttttattttttaattctttaatcaatatccaagtaagactcttatagtttaaaaatagaaatttgttaatgactatgttaataaattataattttaaatttactgaaaattttgaacatgtaatttattagcttaaattaatttctccgtgttttaatctaggtcatttcagagttaggagatctaagtcagaagcactcaagtgtgtatatgaaatatgtccaatcctaggtcaaatgttggattatattcatctttgatgtgtacaaattgagtctcgatattattgggatcgctctttggatcgcaatttggtcattatctgagatattttgaccatgcatccagagtagatatagtgtatccaagattcgtggtcctgcaatggggccatgaagtaagaggaagtggttggctcatccatggtcgatcggcaactgagtcaatagacttggtcgatagacaaccaatagatacataactccttaatctcaagtgcgttagtatgaaaaaacgtaaaggaaaatcatgaattgattgacaattgattggtaggtataacaagtaccaattttcttgacaattttaatttagtttatgaattattttactgttaagtcttcggacttgtatttatctaggtccttattttaaaaaaaattatgtaaattgtatttatttttaaattaaatttcaatatgaatctaattaaaaaagggtaaatagtcatttttatttttgaatgtgtagagagctgaccaattcgtctcgctagttataaattcaaatttttgtccccgaaagtgaaaaaagtgcaataaattaatccattcgttaactttcgtctgttaccgttaatgaaatagcctacatgacacaaagagatgaaaatgttacaaaaatgattgccaacatggctgctaaatagattggaccaaaatgtcaataagtttccattgaacaaaaatgtcataagtttccattggacaaaaatgtcaataagttttcattggactaatttgtcaaatcccaaatttcgtttcatttaagggaaaaatataatttaatcttcatccccacccttttttatcgttgcaaacataacattataataaatacttcagaaaatagggaaacaaacataatagtgagcataatattgattaataagcataacttgtcaattgctctgaaatttctaatgtggtagtaccttacccaaaatatgagactcaaacaaaaatgcacaatcattaagttaatccttacaaaaaatgagactaaacttgattttgtcactacctaatactgtcacaatagaaattttaaagtaacagacaagttatgttcattaatcaattgtgtttgttattatgtttagtctaacttatgtgtgttttcctattttttttaagtttttattgtgatgttatacttgcaatgataaaaaaaaaagagaaagatgaatattaaattatattttacccttaaatgaaacaaaatttggggtctgacaaactagtccaatggaaatttactgatattttggaccaatctatttagtaaccatgttggcaatcatttttgtaacattttcgtccctctatgtcaggtaggctctttaattaataataaagaatgaaagttaacgaatgaagttatcacatttttttcactttcgaaagttaaaatttaaattttcatctttcataaataaatttatgagcactttatatattcaaaaacgatactaaattaaacacaattcgaaaggtcgagatcacatcaaatttttagtagtggccaacttttcatattttctttaactttttcctaatgtctatacttagatgacatctatgcttcttcgtatggacttccattctttaaaaggtttttaaatctctccctaggctctgaattattcaagctctcatcccagaaaggctaaagcaacttactaaaaacacataataggtgtaacaaagttctagaaagaaaaatctaagaaatgtgtacaaaactaaacttaaatcactagaaaatgcatgcaaatgagtaatgaaaaaagtgtagaacgtttttttatttaaggaatggaaaatatgttatgagatgcaatctatcacagtattttttttcacttgttgtgctatttattatatgcaagttttaatttttcacttatggtcacattatatattttttggtggaatttaatgcgaaatggttacattacatatatttttgataattagaataaataaattgataagttgaagagaaaaaaaaacaagaagtatttgtttcaaagtatactttatttttaataatctcattctcaaaaatattattactaggaatgttattgtggagaatatttaaaagtttatttggttacattttaaaactctaaagaatattttaaattttaaaataattattaaaataaaaataagaattgaaatagaagttataaatggattaaaaataacttctctcgtattcttattgggatacaaattttcatccctatgacgaaaataaaaataaagtaaataatattgtaattacttttatcaagagtgaacaatacaaagttatacttttaaaattttaatcaaacataaaagactgtattctctaagttattaacttataattctaggaatgagtttttaatatgttaaataagcacagtccaaaagagtaatttggtctattttctcttatacatttgatctgactaatcctactactacgaataccttgcagtgttttctcttttcttcctttggaatgtgataaagtagctttaggaaggaaagcaagaaacatagatagataaatgtgaaattattgattaggaacgatgcttatccggatcagtgtcacgataagagctaaaaccagaaaagatcagaaagcaatcaatttcatcacattattaaattactaatgctagcgctgtcaatgagatgtgtgagataagggagaagatattcttcacttcttttttatttttatttcttttattattatttttgggaaaataaacaatattcttcgttattgtctcctttcatatcattcacttcttaaaaaataagaagaaaagatgtcaaatcgtgagataaggttgctattcgcttatgggatgattaaagtcactaaaactatcattttgagacctgctataatagttttgaaattaaaaaaaaatataaataaattcttaaaattaaaaacgattgttatcttaatcctttaaatttgttcatatgtaactaattagagtttaatgcttatatcattcaatcacattgcttgaaatactttaaaaaattatttcaaaagtcaataaatttattatatataataaattataattaaataattatataaaactttttatattatcatacatatttttaaatttgataacaatcattttagtctctcacgaaactagtgacaaagactgatatggttaacgaattttgtttcaaaaacttaacttttttttgtttaatttcagaaactggtataacaacattttacaatttcaggaactgaaaacagtaatttattccatataaaaccgatacagaaaatgatgatcatgtatttttctttcttcattggtagcatatgatgatgtgtttttactttttacttcaagttttcagtaaggattgtcgataaggatctgttgggcaatgggcattacatggatgcgattgcgatctcatatattgtttagacaaactttttcaacaggatggaccagacgaacccaagaaatgagatgtttggttgggcaattacttaaatcactctacttttgcttttgcttggtgcaccccaaaatttataaagtcttcattttatcctcttcatctcacttaatctcttttcctctccattttcctatttgacataaacggcccttatgtggatggtggcagctctgatcaagtcatcgcgccaaacatttgtccttgacatagaactcaacttgcaatgccaagtgcacgaagggatcttgaattggtgtctattatggataaattgataatatattataataatgaattgctcaatctataatatatttttttattacagattattcaatccgtaataaaaaaatacattgcagattgaacaatccgtaatatatcggaaaggtgcttgtggtgaagtcggacaaagtttaaggttgtagtgcgattttgggtttgtgtggttgtggtggtcgtaaaagggttctcgactacgtggcagtcatggatggcagcaccacagtcacacacaatgcaaatggcatagatttggggtggagtggttgcgaaagggtggcgcacgtggcggagggcatggttctcaagcggagtggtcatcgaaggtttcgaggtgagatgcgttagaatatatctaaggcagaggttgtgaggtgaaatgtgtttgtgtgcgccgaactagggcaaaggaggtggcgacgtgacaaaggaggaaagagatggtgagtggaggtaggcgatgtgactgatggaggtggtgggaaagaggaagaagagaagggaaaatccaaaatattagaaaattatgagatgataacaaataaaaagggaataattatttggttagaaattaattttaacactaactttacctagaaaaatagtaatgatcatgttgatttaatttgattttgttatgtatttaaatatatattaattatgcaaaagaaaatttaattttgattggaaaaaaaaaatctttagaggaaaagtttattcctataaatttagtgtaatatttcctatttgtttttatatatttgaattgaaatatagtaataaaaactataatttcaccacttttaactttcaaattaaattattgttttcatattttttaaattaaattaaatttgtgtaccaattaacttagacatgtcttttgaaaagaaaaaaaaaacttaaggatgatgttattaaatgttgtatgattattttaatttactatttgattttataaaaccaatttcttaaaaaaaataatcgaatttcaggaatttaagttaatgtaaattaatatattagtagataaatatatatttaatttattgaattacttaatctataattattataatgaaaattattacatttgatgtatatatttactattttcaatttactttcaactagttttttcattactatcaatctggaaaaaaagaaaaaaaattaatgactctcaaaatgtgaacaacatactcaacaaatataatgcatatatatttaatttattgaattacttaatctataatcattataatgaaaattattccatatttatatatttattattttcaatttaccttcaactatttttttcattactacctatctggaaaaaaaagcaaaaaaaataatgactctcaaaatgtgaacaacatactcaactgtctactacacgaaccacaattgttttgtaaactatgagatacgaaggcttcatttgtccctagttttaataaaataaataaatgacggtgatttatttcattaatatgaattgagatgatttaatgcgtaaatttaaataactaatattagaagattcaaattcattaatttttctaattttggttaaacgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataaataaacaaaattaatagagtgtgataacattataagaaaacctacatgatatgatattgtaattaaacgaaaatgcattaaactaaatcaaaaccttaatatgaaaacacaacaattgtctcaaataatgtgattagttataccagaaaatttaatgaaaataagagaaatcatttatattttcgaataattattacaaagtttttcaggattataattccacctagatggaacatctcatgctttaatttatttttcttaacaaaatcattctaaaccaatatatgctaccgttgtttttatttataaattcgtagtaactcattagtcctcgtttactgttgttaaatttgcattcatactcctgtcttacttcatgttgaaatcaaagtcatttatatgaaatatgaaattcaatatatttacgtnnnnnnnnnnnnnnnnnnnnnnnnnnnnnnnnnnnnnnnnnnnnnnnnnnnnnnnnnnnnnnnnnnnnnnnnttttttttttttttttttttaataaaaaaatgtttttttacaaagattatttctatttttatatgactttaataatttttttcatttatataaagtgtataaaatatttaggaattaaataaagataaggacataattgtaaagatagtaattaatattaacttgaatttctaagtgaacaaataaatagaaatgggtttttgctaggtgccaacttacgatactaattaaaaaatcaataatagattttttttaattaaaaatcacattcagatatattaaagatctaaatctattaaaaaatagttttattaacaattcatccatcagtttgatccgtaggcaagtaaatccagacgctcattaccttattaggacgttttgattttatgttattccaaagttttgttgatactcctctattaattatttgtttataaatgatatggacttttgcagtaaaaaaaatagatttggttctttacgttaaagaaaaacacaaattatatcatacaaaaccataatttattgcagaatttacacgttttatttattagaaattgtattttcctttttataatatgaccattttattttactacattcaataatactgcgagagaaactaaatctatttttaattattttccattttattttattagataataaaaattctctctctctctctctctctctctctctctctctctctctnnnnnnnnnnatttataacatcttttaaaagcttataaaaactttcaaataattaaaattactaatttaaattcaactattcttagtttaaaaaataaatttataatatttcaaaaagtttaatattttaagaaagtatttatattttttctttgcatttataatattttttcgataattgaaattattaatttgaatgtaattatttaattctaactattttcaatagaaacatgtcataacattttataaaagtttgaattaaaaaaaagaagtaattctgttgtcctatctgtaggttattgtatagtataatattacgtacgtactaggcttatatagatatattgtcaagggagttctatacctgaaggtattttttttaagtagacgatttatattaaatattaggatttaatatactgaagttctatacgtgataattgttaagcatacataaaattatatataaattatttaacaattatatatatttttttcttttataatgcttctttttgtgattaaaatatatgaattaacttcttcttaacatttattcggtggatggtttaactagttggtttataaagtgtttattgtattttttgtagaattaactgcaagggtatggaagatgaatttcaaagtttagagctgctcgttcagcatgacaacagcgacagactcgcccaacgcgaccaactcactcagcgcatggtcacttatccaaccgaacaatttgaggcgcgctcggtgcgtaccacaactctaggttgcgttttaaggcagaaaaggagggaaaaagggatatacttacactcgagaagaaaaatagaagattggagctctattaggtcaaggaggagacatccttccataccattggagctacctctccaccccatttccctccttccatctctttccaataccctaatcctccattgttgtaagtttctcatggaaatgaggagctaaaacccccattgttgggagtacaccaaccaaacgctttgatgtaaagtttctaactatctatttaatgttatttgcacattattgttatttttctgagctttattcatgctagtagtctgatcatccatttgtatgctttgttttaggttttaatgcatggaaaatgattattaccttaagaactaaaaaatgtttctaaacaatatcatgtctagggataaagtgattgagtttagcctaggttatcgtctataatcgtaatgcaaatcgtttaatgtaactcttgagagattaagggtgaacttaagtgatttaagtctagcacttggggaatcaaggttagattatattagtagatgaaggtgatcgtatttaatgttgaatagagaaaaaccttttatattgcatcaaagttagtttcggttaatgaacttccaaaacctgtcatatcgtattccaaccatctgcatcattccgagtgtttgtgtctcttttcttgtagttattacgccttttagtttatattaagtataatttaatcttatgccaatcattttatcaattaaatccattcattaattaattaacaacaaacgtacattagtcttaagtacaagcaaagtctatatagaaatcgacattttgtcttaccggatctttattacttgaacaattcgatgcggttgctgaatcgttaacaatacgtgtgtaggtatttataatacaacagatggttgtcttgaaaaaaaaaaacttatagacaacggctaattataattaatgtcttaagtatattgattaaaaaatttaaagtataaatatttttattgtgagatagaaaattgtattgtttatgatttttttacacttttatatgatttgcataatattttttttttcgttttagaatatatgacgttttatagaagaaattttgtttcaaaatatatgtcattttttaaaataatattatattaagtacttttttttaagaatatctttaataaatacttagtgggagtagtgcataaaaaatcattaattaaagagataaagaatatattagaaagttatctaatgttttctttcaaattcaacaaattagtttcatttcttaatatttaggtaaaaacctcaaacatagtatattttggaatggagagagagtatatatatatttcttttattttcttaatcaatactttaagaacattaataagacttaaatttgtatataattgatagtttaacttataaccaaagacactccctttatgtgttaattaatattctcctttagaattattcttgaaaattaaaaaaacatgcatctcgaaaatgaatcttcatggaaacgatgctcatttaatgttgcgttgaaggtctcatgtttttccttctaacgtggtgagatgtctgtttcttcagccatattttattgtcttcaaaatttgtgatttcagagaaaccaaacgacaggtttctcagcttcagcttccatggtctcaccttccgaggggttgaagttctaaatttagaccctatctgttactagttctaaattattaactactcgatatgctttgaatggaggcgttgatcaaaatgagtcccgtcaaattgaatcttatttcaataagttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaaaaatatttactcatttagacataacaaagtgcggaaaaataattgctcttttagacttaaaatgagcgagaaagttacaattataaatttacactcacttctacttatatatctttatatatataaatataaagataaagataaatatatactacatagtacctgtgcatcacacccagtaaatttggaggaaaatttatttttggatcatataaaaattatattaacaattttattaatttcttttaaaattaagaaaatccaaaatcagttaaaatgtctaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttctctctctctctctctctctctctctctctctctctctctctctctctctctctctctctctctctctctctctctctctctctctctctctctctcccaaaatatttatcaatatatgtcttgtctttcaaactctaaccttatagaatccaaagattacaaatcttttttcttcttaaaatttaagtttggacctaactcaaatttaaaaattaaaaaattagtttaaaagttaagcgaatgagataaaaagtgatttgataggtcctaacaataataattaagataaactttgatattatcttaaaatttgagtttgaatatataattaatttccaaaatttacaataatttaaaatgtagagttgatctcatttatatattttattttaatcatattataaaataatgatttttttttggtttagtctaataataggaatgacaactccttcctccaagttaatccttctccttttatatgtttcatatttttttgattataaatatgctacttgggttgtattaatttgtctttgttaaggctttcactcaaagcaattgaatgaaataacaaagatgaatgaatatataactcaagtaatttagaaagtatcaattttctataatattaactaattctgtatccacttacgaaacaaatttagaatatatgctgaaaataacaattatactagctagtaattttatttttgctgatagtaattaagtgttaattaattaattttcgatcgtgatgattttttaattatttttttggtaaatagtagtacatcctaacattagtactttaatcagcatgtaaaatttaatatcatttcattcacttgttccaatcaattcaaaggtagtgttacacatttattttgaaaacaaagccttgcacattttgaaaacaaagacgtataggagaccgacatgccatgaaagaagagctgttttatatgaaaaggaagctttgaatcatgtgaggcaattaatgcaaggaaagcttagggtttctaccacactagccacaactcgtacgagtttcaatagtaatctccatcgaaatgagcttcatttataataatccctacaacttaattgaatgtcaggaatctcattaatagcttggtggtgggttttgtgttttctttgcttttcaacaaacattattactatactatatgccatggcattcacatttctgccatttgagttaggtcataaagtattaatcatgtttggtttcttagaatttattaatattcaaacaaactgacctatagttatataatacaatatgtcacagatacacagcaagcaatgagctgggcaggtatcttcgtgatgaaattacatgtattattagtatataccaatctatctatcttatgactcttgtagaaaagatatttaactaaagtaaatactagtactaaataaattcaatagcaaccatgagcaagagttattcaccgattgatacacataaaaatagctaggaaggttatatgagaacgaaattgtatgtatgatgcttaagtaaagaataaaataatgaaaatggagtggctacagtttgcattctatcatttgcaaaggagaaaaaaaaaatctctttttgggatgaaaaaaatatgccatgcatgtcatcagtggttcaaaaaaatagaggattatgatgaagcttaccatgagaccgcagatactgcttagctagcttctccattcaatggagattaattaactatatccgcgcgacacatcaatttgtgaccgatagatatttaatttctaatagtattagtttgtaacgataacggctcacgagacgaatctcttccattcagcatgtgatcaggaaaaaatctgttatatcatatggttgttgatatatcttcctttgtttgagttttcttgatacggaggatctaatatcagcttattcaaagttgcccatttgaccagagaagatgaggaaacgttctattcattgatcggcctaaacatatatatatcttcactatattgtaagaaacaaccatacgatgatggtgaaatgcatcaatggaaaacaaaatcaacaccatacgatgatatatgcctttatatagtagatatatacatgcatgtacactagttttgaggaaagaaacaacctttatttttaaaaaaaagatattagaaaaaaaatctaaatctaaccaaataaaaacattgtcttttagttcaagaagagccagctctcgttaatttagtacaagaagttttacactattcacccataagaaagtataagtagaatacgactttaacataattattataaaaattaataaaattatcctacacaatcatttataatttaacaatagtataatatttttacagatttttcactaagcatatatgtatatgtgcagtatagataaataattggctctggcaagtttgataagatttgggtgtgaaatttatagtcaaccctctatataaatcggtcaccttaatttactctccatatatatatatatatatatatatatatatatatatatatactcgtgtctacctcttctatgtaactgaaataaagatgtacatttctttataaccaaaagatgatatgctaatcagctagctgatcatgagctaatcaatgaattcagtcaaactataatcttaggagagattgatatataaggaaatgttgatcagtatgagacggtttttctgtcaaattttattttacaattttttaaatactatttattttaaaaaaagatattgatcagtgttgctatttgtgcatttggtgtcctgccagggaattgataacgtacgtttgtgcattcacgtgaatgcttttttatgtcattgtgatagtcatagtcatagagtctaacaaatattcatgtgttgaagcttcacatatcttagtaatgcccgggtacttgcaacaggtcctgtgctcttgactcagcagaactaaacaaggtacgtcacacccttattcaaatacgtgggagctatattgccaacttggctgtcacaatccacaacttttatttggcagtttctcagtcataattgttgtttttatttcctctatcccccttcgaacccaaatcagcttaccatatagtgacaattctcaagtcacttactctctcagctatggcctatataataacaatatggagacttgaacctattagaccccgccaatttcagcaataagtcaatacgtgatacagcttttctaccgtgaagcagaaaattttcttaatttgactctcaatgaagcaaaacagaagcataaaagtttgtgtaataatttcctgatttattttatcatgaatatattattttctttatagtgccaatagttatttattacttactaaatatatagttttctattgtgcctctctatttaaatagaatatttttgtattggcgtgtgctttgttgcgttttgttttacacgattatatttttgctgaagtataaaatgtttaaaacatttacttttatcagcctatggaacctttacgctcactagtccgaatttcaagtgactgatatggatccaccaagttacaatgaaccacaaggcctagagatcctaattcctagacagagctaaggccaggtgatggtattatatgccaaagtaatttttttattttaatttcaactctagacgtgacaattaaataaagcaatgcatacaaaaaaaaaggaagaaaaagagatataaataacttaatctcttaatttatctataaattaataaatattttaatagttgaatgtaattgttactttagtgtccttttatttgcagagaaaagagaaagaaaaaacagttaaataaacattaaaatgtaaaacaatgtataattcacgtatttacactccactttaatttaaaatttttaactcaaattattttttattactttaatttaaaatttttaactatttatttttattccatttggttctattctatggaagggacccttaatgacaatactgtagcgtaattagttagcaggcggctaatctcagcggctgtattccattataaatacatcaaatctttcaatcttggtcttattatgtgcaactctttgatttgtgttctattaacttcctctgttttatgcttactccttttctccttttagtcccaaacacaaccgtttttttttttttctttcagttttcctttgtttccaaaaaagaaaaaaaatgggtggaaattccccttgtgcctcatgcaaattgctgagacgccggtgcacaaaagactgcaccttcgctccttattttccttctgatgacccccagaagtttgccatagttcacaaggtttttggtgctagcaatgttagcaaaatgttgcaggtactttttccttactgtttctatttgccttcttttgatgataataataaaaaaaaatacccttttgtggttagttagttatttgatcaatttcagaagcaaagaaattaggaggtgggagattcaggtaagtctttcagatagtgtttgttaatgagcctgttttaagaacttttagaaagaaaaaaaaaattcacattagctaaaattagcttatgctgttatacacaagttaaaaataattttttagaaaaactacaccagagaaattctacaaattagattatatataagcttcttagggcctttgttcttttggagttgtaagtagtgtttatttttagtggatcgggggctctaaatggttgtttcttatgcaatgattcattcaggaacttccagttcaccagagagcagatgcagtgagtagtctagtgtatgaggcaaatgcaagagtgagggatcctgtgtatggttgtgttggagccatatcctacttgcaaaatcaagtttctgagctccaaatggagcttgcagttgctcaagcagagatactctgcatccagatggaacatgagccagtgatgccagcctcacaaattgatctagaccacaagtcttactttctccaaaatgacctctctcagtttcttgcttttgactcttctagcaatgtaatgcagcaattttgcccatgacatggtttcttgaatgaaaattgctcacatgctttgggtttggtctattcattattttgtcttttctcaatctctgtgagacattttatatcatacatctataaactttttctatctaggattctaggtagtgaggagatagggaagggatttctaaggttgaccctagcacttgattaagtaaaacacttaattaaggtacttgtatgttaatgcagccggtgaggacaaatatttatggtcgtaactaatgtttatacaataatatttaaattttacaatttacaagaaaatatcaataataattgattatgtattatatgaggaagaatagtgaagacatgatccagaaccatttaataatttcttagtgtggacaagtttagtaatggttttagaaagtgacaaacattctcataactatataaaaaggctatctcaccatcaggaaagaaaatttacatgtctaatgaacatcaaaacattttgtttttctcaactaaaactgttctcgtttctttagctataattttttatgttgtgatgacaataaagttagaactttaaaccttatataagttattcaaactttttattattaaaccagtcttaagcataaaaaaaaaactaaatgataaatatgaacaatttttacttgtgagtctattaaccataaatgtcagtttggattttaaattttcactaaaaagggtttgaatgttaaatattttgtatgtttgggccttaggacccgatacttgtgaaaaagagaacataggatgtggtttgattattataaaaaataaaaataaaaaatggatcaataagtaacggattgtaattcatctttttgtgcttaaatattgaacggaaacatgtggatattactagcttccttaaagtaaaatggtagttgaggtacttttgattttaaataacaaagtgccaagctgatgtcattcgggcacttatcaattaagttttttttttttataaggatgttagatgacatccgttaacatgaaagaaactaagtgcatctttggaatgacatcctgtgatcatgtttaacacgataattacttcaaattcatttaaatgacatagaagctaaaataaaatgcatctaaaatatgtgaatatgtgagacgtgacatcaaagcaaacaagtcataaattaattgatgatttacaaatttaggaattattttgacatttttttaacttcatggatcaatttgatcgattattagaatttgtaagattaaattgattgataatttatttttttaacgattaatctgtcattttgttaataaatttcataaaccttaattgataatttcaaaagagtaaattagttattcactcatcaattgctacttctttttctttctttaataatttttttatttttctctcaagatataacattccctaatatattaactaaaaactcgttataaattacgtgtataaagatgcgaacggcatgaatagagaaaatgtacgacatacaatgcctttacattgttaattagaagttagatatcatttagctctcacctttctcttaactttgccgtaccatttaggtaaacttgtgaccacaatgaacaccagaaatcacagggacagtggaagctgacgcgaactttgtattccaaaagagaggaaaagagaaaatcgaactacccctagacgtctaaattaaccattacttgattaaaaagcgcatgcttggttcaatgattgagctagtgattaaaacaaatgataacacgtttttaaacaccactagttttaaattaaatctgttggttttggacccttaagcatcttaatgaagattcaattatttgtgatgtatgagaaaaaaactcatgcatgcatggatgaaagagcttagtttccacactaaaaagttaatttattttttaaaaaaattatacttttatttagttatttgttttaaaaatatatatttagagtaatttttaattaattaacaatataaaaaatttacacttacagtgtataattttttaattaaaaaattacatgaagcctcacattggaatgagagaaattgcaactgtcgttcttgtttctttgaattttaaaatgaaaattttattattcatggaattagatggacaaattaaattgtagggagttaaaagatgctgaattatatttgacagcagttgaatagaacaacatcattagtaatttagaatacagtaaatgacaaatattcgtcaatatgaaattctgcctctttgtggagacaaagaaagtgataatgggaaccacatttatattttgagggctcgaggacaatacttccaaaataagttttctttggaattcagatgccactaacccaccctccccagttcccttctctttgactttgttttttattctttcacttaggtcaaagtaagattttgtggcacttttcttcaacaccaaacaaattaacattatgctaaaaaaggctacactatattgagcttgaagctatccatatactccatatcaattttttttttttttgcgcgccgccataatgtatacaaacaaaaccgttttggtgcaaattcaaatgtttaaaattgtgcagcttggagcgttgaacctcatagttactagtattttctagtttttggaaaacaattgttaatgtagttccctaattctagacgcgtggcatgttaggttacacaaagttgaaagttgtaggataatagtgtttcgagtcttgatagcgcttggtatgccatgttatgttacacaaagttgaaaattgtaagataatagtgtttttgagtgttgctaacacgtgcttagttactgatgaatttttgtttaataacgtgcatgtaattgcctagtgttttataactaataaatgcacacactttcaatttaaatctacaataaataaagaaagacataaacaaagagataaatagataaacacttgtcttcacagtttcgttggacttgaatgatctaaagagacttacgtacgttgttatttgtatagaaattatgaacttggaaagcagcaaattatgcttagttttacttgctgcttaggaatcacatccaattcgaaatccaaatataaatataagataggtacttcataaatgacaatttatgatcctttatctccaattgataacgtggagactttgctaaattctgatttaatttgttccatcataaccgcagacctgtataatgaatttgagactagaagtgctagcaggaactttgagctcagaaacatagaaacagtttacatgtgctactccaagatactcctgcacaggttccaatgttgtgcttggattaccatgtgctagctatggtggtttctccacatacacattgcagtgtgaaaatgcaagattctgtccatttttcagtttccaagaaattttaacgctaaggatccttgaatcttgaggaccagatttcccattgatgcattcaccatcaactagcaacgaagtagaaactggaaaatctggcttatagttagaagtcttgacagtgatgtgaccaagagcagcaaaataatcagttgaggaacgcacagcatgatcaggaccaaatggtctggatttcatggaaggagcatttggcctattgcacaaagcatggattccagtgagaatgtaaccattcatttcaattgtaccttcatgtataacccatccaggggcatttcccttgtgctcacttgttaggactactttgctaaattcacttgacagatgatccattccatgggaagtgagtagtacaggcgttgttttgttgatggtagaagtgaactcaatgaagaattgctatcagatttcacctgcatttgtcacagacttcaggtgtcaaatagattaagaaaagtgggtactgatagaaatctcaaattgtatataatgattttggtgaactagtcagtatgtgcactataccattggttaaggaaagatacatacctcacttcccttccctcaaataagtatctagatttagctccctaggaagataagctattttttagtaaatttttatttacactgctgtattgacagctatttcaggttagatgagtctgatggccagagatgtaaaggcataaaatcattggtgcatttgcctttgcgagagttgggtcatgacaaagtattagagtctctatgaccagaaggtctaaacgccattataatttctaataaaaatttggatttcaatgcaaagcaagtaagcttgtgcatttgcctagttcaagcccaaagggtcttacacgaagtggtgtgttgaggataaattattaggtaatcttggatcacatggtctccatgaatctccctatgacatgttatcaagtgttattaatttttccttgtaaattgaaaaacttgaatacatgtcatataaaaattagttgggaccatgaacagtggtggtcctggaccactttataatttctcatgcttgaaatatacaagtaaattcatgtgcctttagctaacaatttaagattttgaaagagatgagcatgtaccctccctatcatgcttcaaacctgaggatagagatatgtacaatttttccagcaattttaatagaggtgatagctttaagaataaatgaagtgaataggcaacttggctaaaatgaactctccttgaaagattcttctcttttaagtaccctctccaagagatccttcgaatgtaaatttccccctccactatatgatgcttccttcaagctacattttataagcaagacaacatatacttgagaacttatctgaactagttctgaaatgtagtaatttaataccttgatttaaaatagaacagaaaagaaaggaggcatacaaaatcatggaagttgtaatactacaaaaactaaaagtacataataatatgagaagtgtttgcacactatcaggtcagccatcaaaccttataaataagttccagaagcacataatcgtagcaatatgtgatacttaatcatatttccagtctcttggtaccaaaataggccctcaaaattcaatatggaaagaaggagcctataatctacactgaattttctgtggtgaatttttgtatcggagttaattttgccagctatacttcaaataatactatgaaagatgcaatatacacactctgttggaatttccagttaaagaaaattataaagcattggatgctttatcactttacaataagttgaatagaatttgcagtagagtcggcaaactgacggggtgcacgacgcggttgcctgaaaggtcctttgggagtgcgagacctcagatatcaacaagttcctccctgacaacgatgttttcttcaaaggaaagaggagaagattgaagaggaaaaggaagggggtggggagtgcaagaaattgcataggggttatcttggtcctttccttagtattttaaaatctaagtagtgggaataacaagaatgatagtgggaatagttgctcgcccatgttatggttttagtagtactgtaataatacttttaacttgttatgctttcagattggttattctgaaagccaatatttataatcattttagaatgtaattctagattggtaatttcataagccaaaaaaaaaaaaaagtgcgagaaacaccagcctgagagaaactatgaaagcgtcatcaatcaaatagtttgtcatctccactcaacacgacaactaattttttgtgtattttttaaaattttggtcaattaacaaaattatttctttatcaataagataataattttagagtttaaatatattttagtttctgttaatataacgattaattcctgtaagaaattttctctcttaaaaagagaaattattaaatagtcttgaacaaccttctatccatgatcataattaatttctatgtaatacatattttaagctttttaatttgaaaaaaaacaaacacttaaatacatgtatgtaaagattaataggaacaatataatagttcaaaattatttaataatttctccattaaaagtttccgacatttttaggataacttcttttagtcactaccttatcctctttttgttatgtgctgatgaaaggccaagttaccgatgccacgtcaatcatgtgaggccacatgtacacaacttattgagtttcttcttcatatctgaaaacctttatccacctaataatctcttgaacgtgtttatataactagtgctcaatgattaaaaaaaaaattaaaattacttataagaagctgtatcagagacatacacagacctcaggtcacatgacttttactgttgctcttgccataaacttgataatttgattttgtagccttactaggatgtggtcaatcttataattcccattatgtggcatttaattaggcactatataatagtaagtgttaaccttggttatgcaatatctcatattggattttctaattttcacgatctaaatagtttggctagtgtatactcaatatgttggggtcaattattggaatccataccatgttacaactacctaccttagaaaattacaagcattggttttatgtgtcagggaatgcagatacactcatatggcggtggaattggaaatgactcataattgatgcccatcatgccatattgttacaagtgggtagttaattacagagctaacacatatacttgatcaatgccacattcataaaaaaaaaaaaaaaaaaaactgtcctatcnnnnnnnnnnnnnnnnnnnnnttattgtctgcttatgatttgtggacttatccaaaaattagctagctgtcacttgcgcatatgtattatgtggaggtgctttttaatggtgttaactaaacagttcctcatcttttacttattattgatgcactggacttgaaaatttgattgactcttatccggacgtagcttgcctataagtaaaaccagtgtggtctctcataaatcataatattactctcttatattatttacctgctaatgcatttattttgaaactataataagtagttctaatgcctgtataggattaaacaagttatagatagttaaggatttcatgatgtgacaagaaataaagtgaaatttagcggggtgtttcaagtaatttttttttgaaaaggccaaaattttattaatgcatagaaattaattagaaacaaaacccatgtacaaggtattaatgcctaagttttggaacagagtaatattgatgccccttctccttgtcagcacattcttccttataaagaaagcaattattgcaacaaccagtagaagagttggggccgtagaagaagcaacaagaattttagctagactccggtgtcctaacatacactagcatattttaccagaagggtaatctttcaaagtattttatcttttcacaaaaatacatgcactagcattgatcaacaaaaatattgtgtatgtttaggtgatccatcgttctaacccttttatattaatgtccaacaaattaacctacaactgcataatatatacctacaacgtctgaaatttctatgttttggtgagaatctaagtaacgacgcaagttagttccaaatggtagctaaatgtgacctaatatatacctaatcacactccacctaatgtccaaaacaaaattaattcttaaagataaaaaaggccatactgttacatcttttgtttatttgggtacaatcatttatatagaaaagggaagtcaagtgattatgattagcaatcttccatgcgtccttaactttgaagccaagcaatgtttataacctccaaacgtagtgttcctctcgtagtatcgcaccatatggatcccactcgacccaccatatctcttcatttcacccttctagctcgcggttgtaattacaacctcttttttttttttttttttttttttttttttttnnnnnnnnnnnnnnnnnnnnnnnnnnnnnnnnnnnnnnnnnnnnnnnnnngaatatttaacatatatccaatttctcttacaactcactttcactttatttttcttcttatttttctctttatttctcatttcattttgtcacatctatcgtttccttttgtcatacacgccgaaattgggatacacgaataccattactctttaagatgtgtataacctaatattgttgtaggaaatgtttcagaagaaattgggacaatccaaaaatagcaactcaaaggatatttacttgacataaaaaaatgacatattataagtaatatctaattatctttatttttatttatttcatctaaatacatcacaaaatatactctaaaaaaagtaactttatttgtcccatcccatttaacattcaccaaacatttttctattaatggctagaaagaaaatgaacaagttgccgtaatcacacattatagtactgtcatgtggtgtggtatagctttcgcttctcattcactgatctttctttcttttttaataaaacattcaccggtctttctatacctactattgagagagtattaaactataatttattgtcttataatgatgataattatacaccttctatgtacatcttataggaagaaaaaagaaaaaaggaaaaaaaatataactttcgatgatttttgtcataaaaatgtgtaacttaaaaaggtcaaatcctttctcctcaaaaaataaatgtcaaatccttttagtagtcattttcttttgacaattttattgtattgagttttattttttcagttaattatataggaacactacgacacaaaaataaaagtgtaatttttatatatttttaatttaaaaaattatcaactaattagaaatcatatataacttttaaagtaattaaacaaaagacaacaatcttaattttaagataatcttagatgacactaacaaatatttacattgtcaatgtattttgttaattaaatttcaaacgtgatactcatattagggttttttggttcatttttatttttttctctttcaattatttatactaatatgattcttttccctatcaattttataagtatatcctgcctgccttccttttgttttctagcattggataaaaatataaagttcagtagtattgacatgaatgctttaattaagcttacattttatgttggcatatttagaaagaaataccgtaattagttgtcaaaataatcaagtacctagctaacaatgaaagttaccatatggtattaaattataagtattttgtttgagtcaaaatttcaaaacaatcagtttctaatcatatgttgactaattcgatcaatttcttccctttatttccattttatgttgacaggttttcaataatataataatttattgttgactggggctggaaaatattatactactaaaatactttaataatccgttttggataaatccaactttaataaaaaacaacactaaaagaatactttaagtgactttagtgttatcttttaattagaatttgagtttaattaatcttgatcattcatgcaagtatttatcacattacccaacttgtcatgcatatattctctctcatgagtaaaaattaatgtataaatattaatcatctttttgaaagggtacaaatacttggtgttcaattatgtggttatttctcttttctgcaaaaatgctgatatatatttattagtcattaatcatgattttccatccttgttaatttggtggttatctataagacagaaatggaccccttaacccgttttccttaactcgcacatttcctcctttttctcttatcttaatttttctgtttagctgttctttcagtcaaagaaaaaaattgttggctatattaattaaagaaaataaaacatacatgatagatatatagtggcaggggagaaataatagagaatcggtagtaggttgggtttggtgaatggtttcatttcatgcaaatgaagccaccattctcaccctcttcttcccttctcagaggcaaagcacgcctctctccctacctctttacccttatagctttcattctctttgtcgctatcctctatggcgaggacttcatgtgcatctttggtcaacacttccaaaactactctaattaccctcacaaactctccaccaccaccggtgggttcatagttcactcacttttttaggctttcttgtggtaattctatctgacaaaaatatcagccacactcttatataataaatatcagttacaaaatagttaaagtacatatattgtttaactgagtaaattattatttaacaacaacaaaatatatgacttaaaacatttgatgaaacattaggaatgaaaatggccgaattacgttttctaattaaagcttctgtttaatttgtggtatcgtgtgatgtgacgtcttcttttgttgaattttggaacaacagagagggtgaagaggcagaagctgccgtttgcggtggggaaggcggaggaagggtgtgacgtgttcagcggaagctgggttcgggacgagttgactcggccattgtacgaggaatcggagtgtccgtacattcaaccgcaattgacttgtcaagaacatggacgacccgacaaggattaccagaattggaggtggcaaccacacggttgcgatcttcccaagtaagccatgtttggtttaaactttggtaaaattatttttgatagagtttatattatttgaaaacttgtaacagttttgtatatatagtattattgtgagtccttaattcgtgtatgttttacttcacttgagcgatttgaaatttgaatgtagttttgtacttaattttgatagagtttatatattatttgaaaacttgtaacagtttcgtatatatagtttagtattatttattggatatagaccatataagtgaattagacatcacatttaaatttaaaattttatgatgtaggtttatggtcttctcctcacttatatgatgtttaatttttctatttatatttaatgtgagactttaacttatatttgtattccaatattgttgagcgaattgaaagttgaaagtagttttgtagttaattttgatagagtttatattatttcaaaacttctctctttcctttatttaccttttatttacgccggggggaacgtattttagggtggtagagcctcctactcattgaatacagatggtgttagaatcaatggtgatactgatggattgggggctcgtgtcagaaaatttggaacaattaaatgaggcaaacttgaaaatatctgaaattttttgtaaccagatgtaataataaacattattaataagctttttcatttacttttttaaatattgattacaatttattaaaaattataaaattgtgtaagttttattttattttacttattgttttatagttttaataaattttaagtaaaagtaaaaaacgtgtaaagatgagtttgttaaaaaaatgttttacaagacatccctctacatgaaatattcggtaacgctcatttaaataaggtaaagattaaaattatacctagttatttaaagaataattccaaaaattatcttacaacacataatatcaattcatcatactttctttgtatggtaaatttgaatgtgttttatacttttaaaatattaaatgaatttattttttatttaatattttctttacagagtaatagaaaactttgtagagtcaatgttaaacaacatttttttttcacgacaaatataatggtttaattcaacctttattgtagattcagtgctagcttggtgcttgaaacacttcgtggaaaaaggatgatgtttgttggtgactctcttaaccgcggtcaatatgtctcttttgtgtgccttcttcataaactcattcctgaagatggcaaatcaatggaaacctttgattcactcacagtattcactataaaggtaaaataactttttggttgattcactttgtgatgtttctagttttagctttgtaatttagactttttttcttctttctattgattttaatgtgttcaattaggaatacaatgccacaattgagttctactgggcaccttttcttcttgaatcaaattcagacaatgctgtcattcataggatatctgataggattgtcagaaaaggttcaatcaataagcatggcaggaattggaaaggtgttgacattttggtattcaacacttatctttggtggatgactggcttgaagatgaaaatcttgtatgttttctattgtattcaaaataacaattgcttagccatctttcatttctttttctaagtagtttgaatataatatttgatttatttatttctcaaatctttagacttggatctttcgatgatgaagtaaaagagattgtcgagctctcaacagaggatgcttaccgcatggctatgaaaagtatgcttagatgggttaggttgaatatggatcccaaaaaaactagagtgtttttcacaagcatgtcaccttcacatggaaagtgagtatagctctctctctttcataaaaaaacatgcacacacttatactgatatacacatcaccatcatatttttgtaagctaaaaattgtggtaatgtacactgtagttgtcatttttcaatgttcttactaacatcctatgtgacaataacctagtgtttcttcataaatatgacaggagcatagattggggaggtgaactaggagggaactgttacaatgagaccactctaattgatgatccaacatattggggctctgattgtaggaagagtataatggaagtaattggagaagtgtttagcaaatccaaagtgcccattacatttttgaacatcacacaactatccaattatcgtagagatgcacacacttcaatctacaagaagcaatggagtcgattgactccagagcaattagctaaccctgttagttatgctgattgtgtgcattggtgcttacctggccttcaagatacttggaatgagcttttgtatgccaagttattttatacttgaaagttgaaactatttcaaatataatagatcttcttgcgttctcatggatcattctacatttggcacttcaagttgtaaatgggaaagcatgacttgacaacttgtggcgattattctttatttgtttggaagtgatgtttggggatggtcacaagcaaaaatcaaacaaatgaaaatggatgtgtgcacaataatagttgccaatcaaaaaagagaagaaatatatgagaaaaattgaattgatttcttctctctttcctatggaagaaatgtaaaaaaaatgttagtttatcaatccctaatatgtcatccatataagttttggtacactgttgtttttagactcgcatgaatgaaaaacttaccaaaaaaaaataattagtttggttattttgagtttaaaattttggaggcatatatattttagtcatgtagaggaaaaatatataatttttttaaataatgtgagattttatttttcttagctttagaaggtgatggcttcttccaattcccttataagatccaccattttcgtaaaaaaaaaaaaacataaatagtattagtgttttgtattttattttactttttatacttctgaaattaaaaaattaaaaagaaaaaattcagggaaagagtaaaatatcttaaatttgcgaatatttttatgaaattatggtactagactactagtttaaaaaaattcatgaatttctaattattctttgtccacaactttcgtgaacttcgtctttcatattgttgttgtgccaaagattgggcctgatattggctttcaaaatattcacttttaagtaggccggttttgttaggtgcacttttttatttttcttgcaatagagtgctggttttattcaaacaaggggtttactaaatacactatatacactatatgtgaacagtacacagacgaaaatgcccttcatgatttgaaagttatggattctgtaaccttcaaacggattacggattgtcgaattcgtaagaatcttacaaattcagcaatccgtaagttttttttttaagtaatacggattgtccgtaagtagtttttttttttaagttaaaatatattttttcaaataatttaaaataatggtgcatgtaagtctcgaacctatgaccttcatgtttttaacgcagcactccaaccaactgagctaataagacaattatgttaaaaaataattaatgttgatacatataatactaaattttttaatgtatatttaatacacatatctaaatctttaattgtttagtttatctaatttctttatcttttcttatttcatattcttattttattaattagggatattatgttcattttatcaattaggataattgttagttatgatcctatcaaataagattctcttttattttaattttatcaattaatgagttatatataattaatttaatttaaattttattttgaatattgaattatttctcatcctattactttcgtaacaaatttttttaatgtatatttaatacacatataagtttagataataaattatgttaagaatattaaagcaatccgtatggcccatacggattggacaatccgtattacttaaaaaaaacttacggattaccgaatccatattcgacaatccgtaatccatatgaaggttacggaatccataactttcaaatcacgaaaagcattttcatccgtacactattcacatataatatattagaaatttatatagtgtatttagtaaatcccttcaaacaatactggtggatttaagcacaataacttaagcctaaatttcagtcttttcttcctgctgtctggttcattgttattccctcgagttgaagaaaacccagtcacatgtgcacgtagtagtggagagattttgctattttgttttaggcccatgaaattcacactcctattttttatcttctcgccccacattatttttgtgaaatttctattttgttgcgtattactgatatgatagaaactaatttctattatgtaatgatacacaacggagaccaatttttgttgagtatcataacaagattttattaagatagacaatagaaattatttttataaaaaagaaaagaaaagaaaagtggccgatgagaagataaaaaagcgaagtgtcaatatcatggacctttgttttacgcattacgtcattagacccaaaaagtaaaatatgcatgaacagaaacaatgctttgctaagaaaacgagaatcatgtgtatgatagatgaaatttcggtcgagatttaacaatatatacctttaatacattttaaattgaaaaattttaaatttgaatttgaatgaatttttgaaagaaaaatattcttaaaaacgtatgtttcacgattattttctaaaatttaccaaatatacacttacattttattaatttgataaatagtccttccatcccaatgaaatcgaattacaaacacacttgtgaaaataaatttctccaaatcatcagctaaattcacttacaatatgtacaatatgtttagatagagaattttaattgaaaaaaataatttattagagaatttaaaattctttaatttaaaattcattatttaaatttttttatatgaaaaatttaaatttttagaattttaaaacagaattttaaataattaaaaatatgaaaatttaattttttttataaaatatgagaaaattgaaattttctttttctataaaagctttcatcgtaccactttttgatctgtctccatcaccgacaaatactctaacctccattatttccacgacatcttcctcacacgcctctccatgcatgatgttcaaaattttaaaataaagaaatttaattttttttatccaaatacaaaattttaaaaataaaagaattttaatttctttatccaaatacaaaattttacaaataaaaaaatttaattgatgtattttaatttttttaaattttaaacttcctaaaattttaaaatacttcgtctaaatacattatagttgaaagtgtcaattcgatgtaaagtaagagtaggagggaaacaaattccaacacaaagggggcaaggatgggcctgatcactcttcttggtacattagtgtttagggggaagagacagataccaacctaaagggggcaagaatgggccagttttttctttttcaatttgtttttttgaaaaattgtataatatattattttaattgttttatataataatatataattttttgattaataattaattaatcatataaaccaatatttatattaaatttaagtttttgttcttaaaatttaatatattttttccttttaattattctcctcagaagtatcgcatgaattctttactattaagtttattttattttcttaaacactattattttaatttagttgttaatataaaaaaatccgacctctctatactttttataatagttagaaaaataaagagagaaaatcaagattaaatagaaaatgagagtgtataattatattaaaattagactttatattagctagttggatggttttttatgtgcaatcgaaacataataataggagtttagtttataatattagttaagaggtaaaatagtccaaaatagtatggagattaaaagtgagtatgaccattgtaatagttaaaggtaatttatttgccaattttaaatgttttatctctctttaatttttcttatataataaaataaattattaattttaataatgagcatatatcatattacatatatttttaattatttgactatattgatattatcttatataaaatttcattttaattttaaatattatctaattctgaaaatatgtaagacttttactataagaaaatcaaaaattaatgatagatttaaaagggaatgtttcttagcgaaggattacagtaggaaatgtattccctcataatttttcgcaaaattggaaaattatatttagcaaggaaatattaccctcacaaccccttgcggctttaagaaagatataaatacaaaattaatataagaaggaaaaatgtttaatagacactcaagaatatgttattcaacacatgtcgattaaaaaaaatacatcatgtatgataaaatttataatatgatcagaaatttataatatgataagaagagataattgaaatatgtttgtatatggagtatttacaataaagaataatttgtatatcattactcataaaaaagtataaaagttctagagtaaaagaattgtaaaaaaatatcaataataaaaatagttaattaattaggttataaacgggctaaataagctacacaactttttttttttttaagttctatttagttcgaaccaattgtcatgaacggtgagaatgaataaccatctatgctgggtccttgtaaaaagatatttttacgttgctggacatccttcttttacatgcagtctcagccaatcatattcttcataatattttgacgaaaaaaattcctactaaaaagcattttccttttcctgaacaaataacaagccaagttaaaactttgcattagactgatttaaataaacaagacaaggcaaatctaaacttcaaataatccgcttaactctactcgtttaatttacacccttactcactactattaagaacctatccttttttcttcctttttttaggataaatggatagttaattaagaacttatccttaaaaaggtgcgtgattatggatgattcccttcctcctttaattttgtttggttggggaaattctgcttttcctgttgcccccactcaatgggagtgggagatagtttctgtcttgtatcaacctgatcatatatgtacgcgcatatgaatcatttttaattcttaatttgtgcttgctgagagcatgcacctgcgcgaatatgcatgtggtaattgctaataaaaacctacgtagtgtaaaatctacctgcaggtaagtgctgatatatatatatatatatatatatatatatatatatatatatataagacgtggctgatcataagaaacaccacaaacgagttcttgatgacactccaaaacacacacgtagacggttcttgtcatgcatttttttttgttggagtgcaaataattaatatcgaaagatagggattttatgtcatgcattttaatgttaattcaatcaattatgaaaatatcaacacattgttgttacaagtggaacgctcagcaatttcttaatttaaataagattttggtttttttttttaaactatagatattttttattggaaataattctgtttgagtcaaataaaactctttatctaaatatttaaaacagaactcaaattgaaaattcttattaaattgaaataaccttacactaattcatatacttgatgataaagtttcatttgagtcttgtgaataatttaaaaaaaaatatttattaaaataatctatcagatttttaacatgcataatttaatcatcggaaaaataagtaataattatacatcaatatcatggtaaaataatattgtaaaattacaagagcttttcaccaaaataaatcaaatcaaaatatatagtaaagaattctatacttgcatgcctacaagtctataagaagcaaaatatcaatttaggtagctagagatatgccactattgttaatttatttaccctttgccttcaaggctgactctccaaccacacagacacgaatgtttctttgggattagagagggttaatcggctttactagagaagaaaaatcttggttgatttggaaagtcttgtgctgtaaattaaatgaccccatgggacacttcgcttatatagttgtaaagtacagaacaaactaaagttatggataaacaaataatgaaagcccttcttgcccacttgcaagacaacttgccatcccaacaatctcttccaccttacagatcatatttgtataatgatgctaatagtagtaactatatataaacacagaagaagaaaagaaaaaaaaagagaatattagagaggaggcaaagaacgccaacttgacattttttacactccaagttgagttcaatcaagccaagttgctatatagaggttggttcatatccaccatataaatttaatactaaagtgacgttgtcatctacacacatatatagtacagaacaatccttattgtacagaaaattaaagtccaaatcacgttcccttaatttaacatatataattaatgtaccgtcttcagggtttttaattctgatgttctttcttgactgatacgggatttaagtactatgctttagggctaggaaaaaaataattaagagaagcttcaacgaaacttgtaaccagccatgctcaccgtcacgcaccggctcacacgctgagaatggataagctcaaaaaattccaggttacattcaacatttatgaagacttaggtggagaatataaacgttatcgaagattaagaagtctctaactgatttgggtttttacttaatagctacgtgttactacactttactgccggaagtactgtgtcttgtgctttgtttaactatatatatgcatgtacatgtgaataaaagtggtttgtgatgtgtttaattatatatgcatgtacataaaaataaaattaagcaaatcaaggttattttggtaggtcttaagaaaatcaaatgtgtctatactgataaaaaaaaatgcgtgcttagctagaataatttcaagttttctataatatattaaacttgttacattaattgaatctaaacactgaacatttacaaacattgccgtgaaacacataaattgactctggatttaaaagttgcacaaaattaagtcataacaatcagctttaatttgaaaacaatatgaatattgacgattgtgataaacattcatgtgagatcaaaatgactaaggtttggaagactaaaaaaaatgtgcagtaagttctttatattttttgggtacattaaacaataacatttttatcgtaaatttggtgactttaaaacactctctatggtcttttctttctttaatatttgttttgtttgtggcagatttcacttactaggaactgttcaaacttcacagcgctttatccggtgggcatatatcaatgactaggaaaaataatgagtctcgattcgctaatagaattgttataggcaattagtttaattggaacgggaatttgttcaatttcttaatctccaatgggtcacgtcccatgaaaaaaaaaaaaaaaaactctttatgcagagggagaccaaaatattaaaaactataaaagtccagcaaatgttaattaatatttcaaaatattgattaaaagtagaagtaatatatttataaatatttcataaagcatagtaatgttctttaacgaccaatattcttaccatcgaacatatattttaactaatatagttaggattatttaatcaatattttattaagttgcgttaaatattagaaaattttattatttataatgatattatttgacccgagcaacctctatgtgcattagataatgtgatttattctgaaaaaataattaaaattatcaaatgtacgtactatatcattatatgtacgacatagtttgtcttgattaaaaatttgaaactttctttctttgttatttaattgatcaatatagagacagaagtatttcaacttatacacaatttaactaataatttctgtgttttagattatagaaacaaattaaatattatttacgttgtataaattgataaaatattaattttttataaaacattaattcttaataactactctcaaatgtaaaaaataatagtttgtgaggtttattcttaagcctttgtttaattttgtgaatgaatcgcatgaaccctaaagagactttgtttagaaaaatacttaggttttgagtctggaaagacttgtgtgaaaataatgcctgaataagttgcttgaagaagtacgtaaaatgaatacttattggtgagcctgcatagacttgtgttaaaaaaatatttgtaacagtttaaactttttgttaaaattattgtggtgtaccaaggattgtacatagtcttgggtacagttaaaaaaaatcaatgtaaaatctcgtgttatactcttttttgtaatctatcatttataagttgcttaattgcatgttttaaagaaaagataatcaattaagtttcaacatttcaagttataaatgcttttcgtcaagtactaccttccgtatgtttaagctcatctttcgtcttacaatgatttcatccattttcaaaagaatttgcaaaaatatttttcaaaatataattaatttaataccattcttatatttttcttgatttccaattagcaataccattttttaacacatcttttattatttacaaaaaaatatttacaaaatagtataaaatacttattaaataaaaattcagattcacataatatcccgagttttaataattttaattagttaacaaatataaagagttcatttgacccatgtttttttagctcgtgaaaaaaaagagcttttgattaagttagtaagagtttttcacaatttatacagaacttgttcaactcatcctagaatactattttttttcccacttaaattccaatttgaatgtttcaccgattttccaatttaagtgtcatagtcttttgacttgtaccgaggctaaaggagtcaaacacttttttttattaagtttttaggcatttgtggactgtggttaagtttcatgaattattaattaaaacgacacatctattaaatatttttattaggtattaaattatttttaatataatttgatattatagaattttattttattttctaaaattattattgaccaataatatagaattttttaaatattttatcaattataattaatacttaattttgtaattaatattatataaaaaaattgtttgtaaatcatatttaaaattaatttattaattcaaataattttttaaatgtatatattttaataattttatgtatttttcttattatcacaataaacttatgttgattaaattaattttccataacattttttattcttataaatttattatttcattgattgagacaaataattttaaattttttactaaatatcttttagtttaaaaggagatttaatattaaaaatatcatatatatatatatatatatatatatcaaagaactccacaatgtggaagacatgtaattaagttggcttacgaacatttcttgcaagtacagaactgttgaactaaaacaacttcgcttgaacttaagttgcaatctaatttttgtgaacttactgatacttaggtttatgctttatgattgaatctgaattctccattaaaaaatattcaaaatatactgacatttttattatatttaaatatatttgttaagtataacataaggttttcacgcttgattacttggacaaggatatcccctagggtttgaaaacggattctacattgcgaaatataaactcattttgtatggtatggattttttttccgtcataagatatattatttttatattgagaggttaatattttttcttttttttgtttttctttcattctcactttatctttttgtcttcgtctcctccatccatcatcaggaatcaaactccgtcgtcatcatcaagagccaacggcagtgatccccagccaaaacatacaacaaatcaaaactcatgatcccagatcaattttgtttttaaagaaaaaagtcaaacgcgagcctccattccttccactttgtgcttccattcctttctcttcgtgctctgcctcttcaacccacgaagatagtcaaccgatgaaggccagtggtggttgcaaaggatggacagagatgtagtggtggcacaggtttgacaaaggtgcgatggttacaaagggcttcaattgaaacagttctgagtagactcccccattccaaccgtcgatcttgcgcacctccttcacttttggcttcgatggcggcagaggcacggggcagttggcgaaagattcgccattcctgtgatgcgatttgcaatggtttgcggtcttcttcacgcttcgtggtgagtttttgtggtttgcaatggtgatgtggtttcgttcgtccttgaatttggttggtgcgatagggtttcccaatggttcacattaaacacttcgagatgggaatttgaagaaagtgatgttattgactaatttctcttcttttctttggtattcattcggtttagtatgttgtttgtaatgagtaattgtgatgaactgatgatctcttttttctcctccatgattttttgttgtcgacggtggtgcatcaaagaagtgggagtggggagaagtttctaacttagaaccactaagaacaaattgataaatgacagacaaaaaaagaaaaaaaaaattaacttatgtatcgtgcgaaacgagtttatgtttcacaccgtagaatccatccagaaaactgtgctatataattataaatcaaattaaagactcattaattatatatatatatatatatgtgtatgttttttttttatgattgtaattgcagaggatcatgatcctttatgcatacatatatgaccagttgcaatcaaaattgaaacagttagaaagagaagtcataatgaaaggaggaaaatcgggacaagtaaactaatttggtcatatagctaatatcaacatatgtatggcatttattcaaatagaaacattctcttcctcttctagtacataaaaaaggatttacaatattaaacaaacaagatgaataaataaaactaattgaccacggatacaacaaccgcagattcggtgcaaaagaagcactagcagtactcgatcagactcaccagctattagaatgggaaaaaaatcaaagaagagaaaagaactacatatattatatgtcacattcttcatttcaaccattgccgtctgaccttgagtcctccaaaaacaaatcctaatggtgttggtacccacctatttcaaacacgaaacataacccgaatccgtattcgaaacaaaaaaaaaaaaaaaaaaaaaaaaaaaaaaaaaaaaaaaaaaaaaaaaacacaaacagataaaagaaaatgttcagtgttaacttcccatattttcagcgatctgagccagggactgcaaattgcaccgtacgattgtgtcgacgaaaacgcaagtctcttctttagtattaccgggcggtatgtcaacgacgtacgactcgatgacaactgtccctccgttgctgccgtcgccgtggagcgtggtgacggaccggtagttcctgaggcggtggtcgccgccgaccacgctgaagctcatgacgtggcgctcgtcgtcgaggatctcgaggcgctcggtgctcgacacggcggggagcccggagaccacccgcacctcgcggagcgcgccgacgcgaatgccatcgttgccgccgccgcctcctgcggcgaccacgtggcagctctttacgaagtgcttgtaggcctgcgggttgtcgaagcgccgcaccaccggccacacggcggagaccggcgcgtcgatcgcctggatcacgaaggagcagcactgattgggccccaccgcgtgcgcgtggtgccgagcaaccatctccgtcacgctaaggcctactttcgccaataaacggcgcgttgacggcgtcgtttgtgctggctttggacagttggcgccgtttgcgatggcggtggatgtgtcggttgcagggctgaatcggtggagttgaagagggcaagtcatatctagttcatgtaatgatgatagcaacaacaatataagtatgtgttcaaaacaaagatattggttttgtgatgttatgttaaagtggtttgtgcatatagagatgttgttgttgaatgagcaagcacatatatttggagggtgtgggaagatgagaggctagtcttgctttgtgaggttttggcttaatatttttgtaattcaagttggacttttattttattattatttagtggttatcttttaagcagttgaaatttatttaagaatataacatctcttaataaacattatttcatatatgtatccaaaacaacctaacttctaaattctaatcacatataaaaaaatgttcgataatatatcctctaatatatttttaaaaagatatattttcttaaacatgttatttattattgactaaaatttattaaagttaaaattttgagtaggtttcattttgttattcaataatttttcttttgattttgtagttttaataaattttaattaataataaaatatgctaataaaaatgtgttagataatattttgttagcacttctcattacattacatataagatgtgttcttttgtatagataaatgtaaaaattaaatttttagtcgtgtgtttaagaagaggagtaatagtaaaatattttgcaaggcattatttttaacacattatagaaaatggagtgaggtatatcatgtaaaggatgatacttatataagtttaaaaaatttaatgaattttaattcatactaatagtgagtagtgtgttaaaaaaatgtataaggattaaaagtgatgattatccaattaaaaagaagacaccatattagtgaagttggagtggtttgataaagagaaagaaggagagggagggtgaggaagaaagaaagagaagggataattggtagtattgaattgtagcaggcggggaccttacgctaggcgtgcaagtggatcctcaacttgcaactgtcctttagactaggttttgtcaattataccattttttattcccaaacttcaactttgccactccacatattaatatttttttgttaagttgcttaaaattattgttacttaatccaccaaacttttctttggcctcgccgtcttattaaaagttaaaactatttttatttaaataataaagtgtttgtatttttatcgccattttgattttccttgttcaaatttgattgactctagacgttgctgtgtgtcctttttctcgtttctttcgtgtttttccttttgtttctttttttcttttggttcattttgtgtttgtttataaatcaaaactcaaaagccgtgcattaattcatagggcatctttggaaatagatcatgtttgaaggaacagtctagaaactccggcatatcaacaagttgatagtgatattgttcaagtggtatattatatatttagtgcaaatgattttaaaatcacaggatatttttcccgtgtttagttttgacgtaaagaagctagttggcatgatcgggaaatacacataaaatatatcatgttgtaaaagtgtttatatattttgttgaaaaattaatttctaatttttacagtgaaaattatcacccaataaaattttataaatatcatatttaatcatcaagaaatcttaaataaatatgtatatattttcatggcgataatgatttatctttaattttcttgcctgtagccttttcttatgagttttaatctttctcagtcattaaacctaattggtccaacactggtatccactcatttaccacatatttacttaataatctatttggacatatttaattgatcactttaatttatccaatatatattaaataacataatataattattaatacaatatgtaacacataataacgttagaaaatttaatttcctaacaatctccaacttgggctacatattgacatgagataattatatcgtatatccttagtgtgcaactatatgctatttatccttagattcctccttagatacaatctggtcaatctcttatatcaatatgagattatgacggcttttgtcactcttaggctaactaaaccttccatggttatcacactaatatattcaacaacatagatcaaatatggatgagtgacatgaaaatttaatgcaatgtgatctctaccatgcctatttccaactaatcattctttagtctttatgatatcaatccttaattttctgcatacacaaagcagaaacacaagcacaaaataaacattcagaggaaaaataacatcaaaatctttattatgtagaaaataaacatataaatatctttacatagaacaccgacataaagaactcccactaaatcatagtgtcatcacataaaacaacgctcatatgagccatatgctcgtgaaagaccttaggcactatgcgtttagttagcgggtctgcaagcatagagttcgtccctatgcgttctatggaaatctgaccattctgaactctttctttaacaaccagaaactttatatcaatgtgcttcgattttgaataacttctaagaaaagttgttggagtacaacactactgacttattgtcacaataaatctttagtggtctttcaataccacttactacatgcagtcctgtgacaaaatttcgtagccataccttatggttggacgcttcaaaacaatctacaaattcagcggccatagtagagaaagctacgagtgtctgcttaacatttttccaagaaatagctcatccagccaacatgtagacataacctgacgtggatcttttactatcttggcatccagcaaaattagagtcagtatacccgatgatctctaattcatttgacatccgatatgtgagcatgtaaccttttgttctctttaaataacgcataacccttttagctgctttccaattatccatccatggattacttaattatctacccaatactcccactttgaatgctatgtcaggacgagtgcaaacttgagcatacattagacttcctacagctgatgcatagggaatcttttccatttccattgtctcaagtttattctttgggcattgttcgagattaaacctatctcctttagatatgggcgtatctcctaatgtacaatcttttatgccaaatctttccaaaatattttcaatatagctcttttatgaatatccaagaatacttcaagaacgatcttggagtatctgaattcctaatacaaaagaggcttcaccaagatctttcatctcaaaattcttagtgagaaatttcttggtttcgtgcaataagcctatatcgatgctggcaagtaatatatcatcgacatataaaattaggaaggtaaatttactcccactaaatttatgatatacacaattttccaccatgttcactagggatggaaatgggccaggccgcctatcaggggcctttggcctggcctatttaaggtctggcctggcctggcctgtttattataaaggccaggcttaggctttttgaaaagcctatttaaataaaaaggccgggctcaggctttaaaaaaagcctgttaggcctatcaggctggcctatttaatatatatatatatatatatataattaaaagatataaatcaatcttttaaaaaaagaaaaaaaataagataaaatctaaataacctaatctacttaaaagataaaaataaaatagaagatttgaaacactataatagatttgtaaaaaaataaaagtatatatatattaaaactaaaaagatataaatcaatcttttaaaaagaaaaataaaaataatataatataaaatctaatctacttaaaaagataaaagataaaaaagataatttgtatgtaggtttataaattataaaaaagtaaaagttgttatgtttgttttannnnnnnnnnnnnnnnnnnnnnnnnnnnnnnnnnaaaaaataaaagttgttacgtttgttttaaaaagagaaataaaatataatctaattaaaaagataaaatataaaaaatataatttgtgtgtagatttgtaaatataaaaaagcaaaagcactacatattagtattgacatttgaactcttatatattaaacttatggtattttacttagcttgtttattttgtttacaatattttgttgaatacttaaagtattccaattataattattaattgggttgttgtgattagtaaattttaatctcatattagagtactctaattaattttattttttttcacgcacaaattaaaagggaatatgtgtcttttttatattaaatttacaaaagtattattcgaattctcgaagttttactatatagtcattagattttttttaatatataatatttattttaaagtaggctttttaataggctcgtaggccaagccaggcttttaaatagactaggccagacctaaaaaaaaagcctatgatagataaaaaggctaggccaggctttatatttttaaattaggccaaggccaagcctaaccaagccaagcctggcctcgcctgtttccacccctaatgttcacctcgaaaccataagagattataacttgatgaaacttgtgataccattgacgagaagcttgtttgagaccgtagatggatttctttaacttacaaaccatagactttgaatctccaaaaacaaagttttctagttggatcatataaattgtctcatgactctcatcaatgttgtcattgagaaacgatgtcttaacatccatctgatgttgctctaagttaaaatgagctacaagttccataattgtcctaaaagcaaagttgtgaaaatcggttcggtcattgacccggtcgacgtagtgggttagtggtccaaccggtgggtcagtaattgatccggtctgactcagtctatattaaaatttttaaaattatattatatataagtgtataattaacattatttgattaagaaaaatatattaaaaatttaaaataataattatagtattaaaattgataagaaaaacaagtaaagtgtattaataataaaagagagtgtaaataacaactatttaaattaaaacacaagttcaatttttaatttaaaaaatgagcaaaaaggagtacaaaaaaaaacaaggggggtacataagcaaattagtatctgttggcccatataaacctaaacgtaaatcataatgatataaatagagcctgccagtacgttgcgctgcttctcttctccattagaccatttccgcttctctacaatacatgcatcatgttgtgccgattctccatttccacttctcttctccattggaccattttcgcttctctacaactacaatacatgcagcaagtcatatccttatttttattatatcttctccatttccgcttctcttctccattttctctttcaatcgacagtggtggagtcgagtagcggcgacgacgtgcacaacccggtccgggtcctaaaaatcgaccggattttcgatttttcccaaaaccgtccggttttctccaggcgaaactgggtcacatgcacgcgcggttcgataaccaactcggcccggtcatgatactgaatcccgattgaaccggtctaaccgaccgagccgaaccgagtttcataactttgcctaaaagagtcttttgaagaaatcggagaaaaagtctttttatagtctatgccttcattttgagtgaaacccttagcacaagacgagccttatatctttcaatattacctttatgatgtttctggggattttactgggtaatgattttcaccataaggattagaaattaattttccaacatatttttcataattgtattttaaaagagaatttattttgaaataaagccgtacaaaggtttaaactgagatttcattatttgaaaggaatgttatccttttactaaaatcaaatctttttttataacactaaaatcaaatcttaattactttaaaagtgttcaaggtaataacctcaagttgaaaggatttggattttagaagttaaatttgatatattttcaaagtgagctcaggccatattttgtgttattatcatataacaagttaataattattatgataaatatatgatgttataaaagtgtctatcacaataattattaatttcatcttactactttttaatatttttgtgtatgttagattggtttgatgaattgagtttttttttaaacaaaatattttttcaatttttgaaagattttgatgagtcaatttatcacttctagagtgacttgcctttcctcaaaaaagaaaaaaagagtgacttgcctaacacacttttcctcgttaaaaatatcaatcttttattagagtttgatttttcatttaatttactcatgcaacatttctaacattccatcaagtgaaacttttattgttggttctcatagttttcttccaaattttcaccaacttttgccaacttggatttttctcttcccatttattcaataattaaaccacgtacatttttttttgaaagggataaacataattagtccattatttcattatctaatatcgttacacaatcagaaaaacttttttttttcgtaaaaataaaattacatttataaaaagttgatgaaacttacactagataactttaaaagtcaatacatttttaataaagtaaataatttatacgtggtctttcaatcacaaattattatttatattaaatttacttattttataaaaatcatcttaattaaaagatatatttatcataattcttgttgtgttcatcgtataacaattttagaccaacagtataaataaaaattaaattcttatttatataaattaagatagaaatgcatttttattttggttcaattaaattatgtacttttggtttttgggttcctatataactttaagggaaaaaatgaataaagtccatgtatcattcaaataatatagtatatatctagataatcgcggtaaagtttttaaaagcacttggatgttagcaagttagcaacgatttagcataatgtaagtgccgttgcttctaattaaaaaacttgtgcagtattatcaatgtggaattatatatgttttcaaaaaaaaatgtgaaattatatatgatttacacatataattttagctaatgttgtatctcagttgacaatatatgttgaatttgtagggattgacaagtaaaatatattcttgaaagcaataaagagtcttgaatataattaagttctaaatcacttaggaaaaatgaaatacataaataataatgcgtgacaaatatgaaaaatattatatgcataatataatgatacatgtaacgtttccctatatcatctttcaaacaaaaaagataaccaactcttttgtagacctttcgtcgacgatcacttcatctgcaatctcagcaattaagcaattatgtaacataaggccattttcatgcaaacggctgtgccagcatatgcgtgcaattgtcacgaggcaattgctttctgcaccatcaaattgattttctgcacttttttaatctttcaaaaaggctattatgcaatgtgaaattacattctgaaatagcttttgcgaaatataactttatatttgaaaaagactaattttgaacgtaattttacttcattgattaggtaaaaaaataatcatggaaatacagaaaggaactgccttgtcacaaattaacccagctaatgtggtatatgatttgcatcagaaaataatatactatatattaatattcatttaattaaatgatcaaaataaaagttgttattattttgaatgaagattaaaaaatttattgaatgttgtcaatttcattttaaaaaaatgataaaattggaaggattacactacaagaaaaattaaagttaataacaaaacaatttataagcattttttatttatttataagagcgtcattaaaatttttgtgaccccaagttaatgacaaagaagcaattctcgtctctaaattatcttctaacatgccgataaaaaaattatcttctaatatgattaatatttgactaaacccatattaagagaaggatttggattctgaacgttcgagtaacatcttctttcctgctttatattcttcccgtatgcaattgagaaacattatgcattgcattagtcactattaatttatttttgaaggccaacatgcagacaaagagcaagtacggcagaaaattgaactatgttcatcctctggacttggctcaaggtatatcaaaagaaatttcgcttctcctaccaacaatggtaagtgagttcgggaagctgtttgattgttttgtagatgtaaggtatacgtgtagaatcatggttttaaatagggttctgcaacagtaattgcatctgcaatgtcaaggtattttaacttatcgcaaagcaatcgtaattgtagctgtatcattttcctgtaattacccgcagtataaaggttttctgacttaatataaccgcgattgtgatcgtaaattaaaaccatgatgtagatggaacaggaatttagaaggttatatttagctgaaatcgaatcttctgttatacaatcaaccactgtttgtataggaaaagatttgagttggtcagtactagatagtctgtgtttcattcttgaactgctggtatactaaccagaattatatccgcacatgacagtggcttgtttcttttgtaactatttattctctttgtagcacttcttgtgcattttttaaactattgaatgaggtattgctgagaaaaaaaaaactatttatgatttaaagaaaaatcgtttcaatataagcctatgctataaattacacattgatatttttaaaaaacaatttctcgttgctcaatatatatttgataagtaaatagccctacttttattttattacgaaattgatatgaagtaattctatcaaaacgaataattaatttttgttaaagaccataaacatacacaaaatgatttttttttttaaataattaaccatgattcaaatactgaatcacttaattaaggggtacaatccaactgtcacttatatcaatccctgttcttactgtaaatggccgtactagtcatcctattttataatttacaactgacataggagttaatcacttgaagaattaagaaaaagcttagaaataaaataaataaaactgattagaattcaatgccccttttttcctttttggtctcaataattcaccggtacagtatttttttttttaagaagttgtaaaattgtctggaataaaaattttaattagctacttgattagaaggatctgaaaactaaatggatatggaggaagccgtgtcatacactttaaagaagcttgttgagaattgagatgtggggttgcgtcccttattgatgctcttgctgcttgggatggtcctgtgttgagcaaggtaagtgtgacttgaatttttttcctttaatttattcatttttaaaatatatgcgtgaaaatgagaagattaaggtgcattcactagtgatttgaattgaaatacctctttaacacatttgcaattatacatttttaccttctcatttatccaagaaccatatttgcatatttaaaagatttgttaaacagtaacctatcagcttataattaatcatctaggtgtgaatctagatcagctgcctgtggtaatcaaggatgaacatttagaaatgtaccatatgctgaagaacattgtgtaaaatcacaaaggttggttaaacataatgcatgttccatccttaatttgaatgttatgatacaagcctaaatagtatgcaaattgcagacaattgcaaatgtaagatatttaatgcacataatccactcagggacaatataggatagataaagatgtttgattttcataggtaaaagagtatttagtatttaccttttatttgttggtagaagctttttcattcttcatgatcatatggaatgatttagaccggtcctccgcaaccatttccctgagtatatcatcttcaatcttctcagcttgccactgagaagggtcctccacaaaggcctcactgaagatcatgcttgaaacccactctttccaagtggttcttttgtacttatcttcctccaatgaacctgtcatcaagagctgataaacataaacaactttctgctgaccggggcgaaaggcacgggcaatggcttgctttgtttttgaagggttccactctgagtccaacatgatcactcttgaagcagctgttaaactaatgccttcagcacaagcagtgattgaagcaagtagtatctttgctactccaccaggctcctcaaacttgtccatcactctccccctttcaaacagctctagttccccagttagcaccaacacttccctaccttttgtccatccaaagtacttctcaaaatattccacaaataacttaacaggtgcaatgttgtggcaaaatataagaaccttctccttcttgacaacccggtagataaggctcaaaacaaattttactttggaccctattctcagatcaaacttgcatttctctagctccatcaattgcgccggagtgaaaaatttctcagcacatactgctgatttcaccaaccaaggatgtattgaacctagagttatcaaaagctctaactccagtgggtatccattgactttggccattttcttgtgcagtccatgcaaaatctcatgctgtgtatcagttgaattcatcagcaatgtataaatttgcaaaccaggtagaccatcagaactcccaccttcatacacatcaatgaaaccatttgtcacatttctcaacatctttagaccctgccgcctctccctaccattacttgagtcaattttcttagcaatttggtctaagaagaattttctagctcgcgactctaataaatgactcgctttctttgccactttccctttcctcttgtatttcgggtccaatgctttcagtacttcatgaataaactttggccttgccaagcacaaagtgttgaagtactcgcagaaattgttctgaaacaatgtaccagaaagcagtattctcagttctgtctgcactttcatcaaaacttttctcagcctagatttggtgcttctaggattgtgcccttcatccagcaccatgatcccggggctttccctcaataccttagccatgtatttcctgtgtgcaaacttcgaattctctcgcatcaatgttaaaaacgaagtataacccatgatcagaacactcgggtgtgaatgccatttttgtatcttctcaatgcaatccaaaacatgcttgacatcatcagtgggcttaggaactccaggaataacaatcgatgatttctgcttgaatacacggtaggttctacgaccatgaatcagatacactggtataggaatatcccacttgataaattccttgtaccaagtatatagtgttgtctttggagcaaggactagtggccttttccctgggaataacttcaagtagctaacaagaaaagcgatgatgagaaatgtttttcccgctccaggagtatgggatatcacacagccacctcttcttctggatgctgcttccatcaatcccgggtccatggaccctgcaatgttttgccaaagaaactcaaatgctttcttctggtgggcgtgcaactttgctttaagttcgggaattaacacccaaacgttatcattttcttgagacacgggtttctcaggagagtcaagagctggcaagagatcgatgtcatcgtcttcatcagccttggtcttggaaccttcttcagggctctgcttctcctcttggtgccgcactgaatgttgaatctacaataacaagaagttaatcagatacagattggggagatagacaaattatcccaaaacaggggaatgagcttaatatcatgtacaaattctatgatagattttgcaaacagaaaaaatatctgcctaatgcattatgcatcaagatggtgagttgatgcaacagtgagttagtagccttgtgagttgtgactgtggtcacatgctggatattgtattatcgaagaccacggtgtgttcatggtcctgtccaatttacatgtgacaattagccaagttttatgaacctttctcataaattgaacagctcagctacgtagtcatgtcacaagattacatagccataatcctcgctttgtgaaggtatgggggagggtcattgtatgcaaacataccccaggcatatgcaaaaccactgtttcaggattcgaacaaatgaccaactgaccaccaatacatgcatagaagaaaattacatataaattcacttaagagcaaacaaactcaaggagatttttttatgttttaaactacacttacaaaggggggtgtaatatatttgatctcagtgctcacaaagccacatctatagcagtaaattccaatttcttcattcattctgaaatcatgaggacaacctgcattcggattttccagagtctcagtgaaaacagcagcatttgaatcctgattaaatagttgaacagaattagccttaggaaaaacaaaacaaaaacaaataggggaaatcaaaggccaaattgacacatacctctgtgtcttcttctagatagcatgatgccaatgacacttccagttctctccacagcatatccatttcagattcttcttctgcatcctctttgccgagcacctcagtttctgtcttttgcccaatgctgcttggtgtttcgctttgcttccactggtcagcaatagctggttcttcattggttggtcttgtattaatattcttcaagtatgaatttatcaaatccttgtaggcagctgcatttaaggatctgtctttataattgtatctctttccttctccatgatctctacttcctaaatatgttgtgcggtgttttttccctttaactactttactggaaccaatcccttcccatttatttccaagattcaccatatcatccagatcacttaaacccttcctctgtgacttaggggcgccataactataatgatatctcgatgacaaatcatcactcttttctccaccatctgactttgcagcatgataatgagactcaaaagttaacaatttaatatcgttcttctttgaagtggtaccagttagatgatgatacttggaagaaattttagaggattcattaccataacttctagtaaccttgtcatttagatcatcacaatgcataacttccaccggatcatgttgagcaggaagaggattaatagccagatgattctgatgttcattctgatcatcacctcctgacttcactttctgggatttagttttcttccttttgtacaccacaagctccctgcatgtactcatcttcttgaccttttgatgattgtcagtatccccttctagacacttcttttgtgaactaaacagaccggataatggtatatgcatttcatgatcaatatcatcatctttccaagtgtctatcttaactggtggtaagtttctaaaagaaccaacatcaatctgggaaactttttcgcaaccaaggtaacgttcaggttgtacattccgacgtttggaacgccgtaagccctcgacattgtaagatggtgattctttatcttcatgggattccttttcaggatcaaccctcttggttttaagagtagctacttgagaaacaatgggtactaacatgcctttgtcagttttgaaactcacaacatcaatgtgagactcattgttcaatgaagtgctaacagtatcccttcccaaaacttgatacactagcttgtcttgtagagatcttacgcggattgaaaccttcttcaaagctgtggtaacaactaaccatgaaagatcacataacacttttcccagaagcaatttagtgtgtgatataatggaacagtcctcagatgatgcccaccggtagtgctgattttcacaaggagtactttcaagtttttggaggatggatatttgattgattccaaccactttgatctccttactgagagttcttagctctgcaccgagtgaaccttgatgaacatagaagttgacataaaactgacacgagcactcggagtcatgaggttttctttgtacagagcttattttggcatcagcccaaacctgcattttaaaaaagaaagaaagtgtaaatccttgacattttggaaactaacattctcaaactaaaacagaggtcttatccaagcagcagcagcagcaacgataataataataagcacagaccaagtaatgcacgaaaaaaaaaaaaacaagaaaggggaaaagccagtgattgcctagttaatgcatacaaaataaagtagaaactatttaccatgtaaatgtgctctattttcttatcatctcacaaaatagatcttgaaatcaaaatatctctccaacaacgttgttagcgccgccataacgctgtaatgtggcattttttgacccctctgccatagacaatttgtgaaggaaggtctactatggcgccaccataagccacaatggcgtgttatatggtggaatttccatcttctgccatatactaccattcactatattctgtcatccgtcattaataacattactctcaaacatataatttcatcaaataagtattgaaaaaagagttaaatatgcgtgcattattaatgtagcagtttcacaccattggtcaataaaaaatgtcaactaatatgaattttatgataattattataaaaattatcaaatttaccattcatgcttgagaatgttaaatccgtgtatatattatttatccttgagaaagtgtcaaaataaaggaggaatcagagcatatctattgcataaataacacatcatgctcactccttctcataaagaaatttccgggcatagaaaaagttatattgcattgcccatgtgatgctgtcgtaaggcttgtagattctcccaaaaatgtcatgatttacagaattctagaacctcaaattaaacgtataaaattcagtgtaagaggaacacttacagggtcgagattaatggcatctgcatcatcagattgttgaggggcagatagcacacatacgtcaattccaggacgtagaaaacgggagcaatctgataaagtagctttccttgaccttatccgtatatctgacaagggtcctttatccataaccataagatgattatctacaaaatgcatggacatagttcctacctcaatttttatgaactccacagcttgccatgagccaaatgcaactgcttcaaaggctgtttacaaagacaaatttgatgaagccaaattggttaaaagaaaagagtatttgctaaagaatgcaaaattgtgaatatatgattctggaaataatagacaaaacccacgttacaaaaaaattggtcaatcaagtttgtcctgtaaattaaagcctcttttgacattgatcaagtttcaaggcatgatgttataaattataattgattggtatttattcttttcattattttacttttcattggcattcattcatagtgatcaattgacccaaaaaaaagagagagagaagaaaggcttacggtgaggactgaatggatgcttgagttgatctaaacgcctttttctgtgtgccattgattgtgacagctaactaacttgtgttgtgagcttctgcagcagtgatttggcacacaaactttcactcacaagactgaagatttcagttcatatctgttcacaaaataaacaggctaatcaatgacatacaaattcagtggatcatatacatcatggcattatgcatatcttccaaaagcacccaaaaaagagagctttatttcgtgtatgttgttttctgcctccaaaacataagaggaaaattgagaaaggagaaaatggtgtgcctataaatacgcacacaaacatgttcaccaaaagaaggagaaggagataaactaaaccaagttcaactgtctcatgttttttttcccccaaaaaccaaatcccccaacaaggaaagcacccttatgtgtcaacatgcagtgttagactgttagttaagagaagtagacacattcacacatgtgaagagttctacgcttcagcaaggaattatatactgaaatgacaaagaaaaaacatcattatctgtgatacccacttgtgcatacacagaaatggcaacagtgttatgttgcccaaagggccaaaaaagttttcttttttatggaaaatggttggttttgattaacaagtctccacagagaatccaaatattcagcaggttgaacaagtccatgatcagcaagcatagactttaaatggacttgaaaaaaatgcatgtatgtatgtatgtataatccaataatccatcatcaggggcatttagattttctgggaaaggcagaggaagcaaagagtgatgatactcaagtgagggaatctatccttaccaaagggaaaaagctggtgtctgtgttctgagaagaatctaaaacacagtttcaagcatcactgagaagagagagaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttatttagaatattattattattattgagtaaatattaaatctttaatttttttagaatattttttaagaacctaatataaaaaaaaatgtattcactttatgttaccttgaatgggaaataaattcaaaatttgatgaaagacctctattataaaaaaatattaaattattttaaataatttaattttattatttaaatgatgaataaaatagagaaacaataatggaaaatttttatagtcagaaaaaagccaaatttgaaaacagattcatagaagaagaagaagaaaaaaggcagctattcacaataaatgaatattcttcattaagtaaaaaaaaaaatcaactctatatttttcaaaaagagaattactattaacatagaagaattttatttttttaagaagctaaaataaagactttaccatgtttatgttacctgaatgggaggtaatgatggtgctggaattggggttgttgagcaagaagtgagtgcatggagaagtgagaaaataaaacataataaagtggggcgtgaaaaggtgtgaagtgtgaagaaaaagcagacacagacacagcatagcagcggaaaaatctattatatatatatatatatatatatataactaatgagttaattttatgtaattattttttatctttatattttttagactattttaattttatttttaataatattaaaataataataattattaaaaaattaattatataaaggaaaattaatttattaatcaaaattagataatcatccacttatgattctctactttgatttggacaatgttagaagaggggtttatacgcggttaaacgcggggccataacaggtactagcttgtaacaacatttgttagtctactgaaccaaacaaaatagactcatgactcaactgaatctgacaaaagacaaaaatattcacatcaacccaatacacgtcactaatgtccacacttgaccgtgttttacattttttatgataatattaaagtaaataaataaaatattaacatagtccttaacatgatttaatatattttaagagattgactgtttattttttaaaataataatgtgattagtttattttagaaattaaatattcattctaaaaataaatatttattagaaatcattttaattaaattaataatttttattattttaaaaaatagaaaagtacatcttttagtaataaaaaattgtttaaaattaaaaaatcaaataaatttgccttgactttgaatacttaatttaataatatcattattccctcccctccattataattatcctgtaagaaaaaaaatgtgttctaagataattgtcattttaatttttcaatgtaacattaattatttttttttatttatatctcttataatattaataataaataataaaatctataaataaattaatgataatataatattaattttataaaattattattctcttttatctattcattatctttcttcataagtataaaataatttaagataacaattattttgagacgaaaggagtatatgaatttaataagcttatattaggagtgtaaaaaaaatgaatgctatcaatcaattaaatatatgactttgaagataattgttattttttactttttttaattatgatatttgaacgaagtagttctctgaggatgacaatgaataaggtttaggtatggtctaataattctcatcctcatatgcattttaagaaaaaaaaatacatgtaccccgacctatacccatgtggctaacaggtctaatccccattctcttactcactagatatttatatactcttacccacacttgcaactcctactttacttatgtaaaaatttaataaatcaataaaaaaatatgttaattaataattactataagtaaattgaaaatttattattaagtaatccaaacatgactttaaaatgcatataggtggttagattaattaatttgtcatgaagtttaattttatttcaagactactcgtgacattaaatggtttaaggggtgtttattttttaaagataactttttaaccaatgaatatgcattgctttgctaatagctcaataaatgcaccaattttcatggaaaataagtgcaaatcattaatcgatcttataattaattagggataacaataaattttagcaattaagtagtcttatgtttcttataattaggactaagaaaatgttatcttttattttttatatataagactagaggcaatattaaaaacaaacaaacatgacattgatttatccaaatttaactcataaataaataatattacaaatatcatcatcccacattacaaagataagtcattaaatagttataaatctacactactaatttgaagcatcaaacaacacaaaaaattgattcacaattgaaaaccattttcaaaagaacttgttaacaaattatcaaatttgtaaataaaaataaataatattttaatattcttaaatacaatgtaaagtaagtttaatataagggattttgaacagggattcattgttctcttttagattgttactattagttataaaattataaaaatatattttttttttataaaaaggtatatgtataatataaattatatgcttaattaacatattttaattacattaatatatataacatatatgtgcggggcaggatgggacaacaagggaactatagtatccataactacacatattcttgcaaaaaaattgcatgtaaatactcgtctccaccaacaagcggataattatccttcccgcttgcaaatacttttgctggtatcgacagggttcagatccatttttacatccctagtgactaatgtttgtaaaaaaaatcgtgagcacatacaagatacatatttttctcccaacacgatttattttatacttaaggtcatgattcaattcctaaaccacttagttaaaaaacataagtcactatcacttattttcaatcacattggtataaaaaaactttataaatcaattcaatgcatgcattgatttttttcatagtattaaaggtttttaaattatttaatgctagtattttattttaggtataatacttgtacttttaaataactaaaactataaaagaaattaataaaatatatcaaatatttattactagtattttcaagataatcattaacaattactattatttagcaaaaaaaataaaaatacaattaattacattaattaatgtaaataaaatattgtgaataatattttgaaaataccaattaattttttattaaatatttttagttatttaagggttcttttggtgatcaaaatagaataagataattatcatgttgtaatccattatttgttatgataattatcagtattttaatttattttgatagaagagcgaattaagaagcaatattatagaataagccatttcctctctctctagagggatcaaattatattggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatactaatataatttaatctctctttttatatatatatatatataattattttttatcttctatgagaacaccatagaattaaattttatcttgctgttatcctattatattatttatcttattatattctatcatattctgaccaacgaattctaaaaatataaataattttgaaacttctaatattataatataattgatatgttattctctgtaaaaaaaattgttttgatataaaattattgattttattaaattgttaacgttttacaaatttttagtcttgttaattatttttgcctcatacttttatttaaaataattaaattttatattttcaaggagtatgagatttataccttattttaacaaaaaataaatcacatatacatttttattaaataaatgtattttaaactaaatatagtattacgacatagtatattttatattccttaatctatatatattaacattgaatattttccagtaaaaaaaagcattgaatatgttttgtgggtacaaacataaaaaataactacatattaaattaaggcaaatatttctcgaaaacacaaagcatggttataagggtgaggtacgtcgaccaaaaaatatcataagttaaaccaaaggctgtgaatgacttgagattggtaaataattgtttcattaactttcatagatgcccaagtggtggggtccacaattcagagactattgccttccaggctccagcagttgcactgttgggattttatatatgttttatgaggggacttgataaattaggatttacgaaattaaagaatttttttttaattcttatatgcttaaatatgaggattttatcatgtaaaaaaatatattatggttttaaataattaaggattttattgaccaataagttattcacaatgttgacaaagaaataaataagtatttttaattaaaaaattaacataaaatatcttagattttttgatggaagtatattaacgataattgtcaatatttttatattttaaatttcttaacgaatacttttaatttatttttttgatagcaagtgaaacgaaaaaagaatttagtactggagttgattgagtagtatatatgagttgctgtaaacttttagtactggagttacactcttacattccaaaaataaaataaaaaacaattcatattgttaagaaattcattttttatatttactttcttaatcatcaatctaaacttttaattttaaaaataaatgttttgaatgacttaaaagagtaatattaaatgaattttatactttcatcattattgttttctatttttgacataataatacgttttaatatgtataaatgtaatttatataaaatgtatctttcataagacaattataaaatataaatttatttaatattgaatttttcattaattcaaaaaagtaattttaannnnnnnnnnnnnnnnnnnnnnnnnnnnnnnnnnnnnnnnnnnnnnnnnnnnnnnnnnnnnnnnnnnnnnnnnnnnnnnaataataatatcacttttaacttataaaatagtattttatataaaatacatattttataagacaattacaaattatgaaattcatttaatatttactttcatttattcaaaacattcttgaatttcttaaaaggtaaatattgaatgaattttattttttcatttttaatacttttctattttctatcataataaattttatcttttatttatttatttttactttaaaggtactaaaaaattacttttgcattaatccatgcaggcaataagttggtaaccaaattcacctatgaattttacgatcttacttagacttactagtaaatatgttaaactttatcatatctgaatttgctcgggatgcaatattgcttcacatctacttcactcgaaaagctttcatttcatagtctagcatcgataccagaaaaaaaaaaaaactttttgttagatcatgagaaaaaaaattcttgaaatatattgtgatgcagtgtggtaattaatatgtttgaaaatgactttattttgataatttgttcgtaatttgacaccaatttggtcaatcaaccaggaaaatggtgccaatcaaaataaaaacaaatacaatattagtcgtctctggtaatactatatatatcgaatgatgattctgtaagaaaagtatcattaaatatataattttattttaatttgcataatttaatacatgatttaaattctagattaaaaaagtcaccctcagtatataatcgcttctagcggcggcaaatgatagttctataagaacgaaaggatattagaaaaagtaaattaaatatgtagtttcatttaaaattgtataagttcatatcatttagtttaaatattcgataattcactgcataatttcataccagcattagacacctagtaggaaaaagacatcgacgaagatttgctctcaaaattcataacttgactcgttcacaaaaaatgattctctggtgtggtacatttgttgccttataaaagcatcaaataataaagacttaataactaatcaattaaatattacaaactcttaaaggcagttgatatatctatttctcttctttgcttattcactcttttttcaatttattttttttaaaaatacactctcatatttacttaaaaaaggagaatgaataaataaagaagggaaatagatataacaaatacactcttaaatgactaagcaaaatctgaggcacaagttagcccaagtataaagcagccgaggctcaggcccttactttatgtccacagaaaaagaaaagttatttatataaattttagggtttgtctaacacacacaaacacaaagtaaaaaaatgagattaaacaatcccatctttaatgaccaatagaatttaaataatcgtcttattttaaattctatcattaatacattgattatcatatttaatgcattatccttaattgctcatctcatttaatgcattatcatatttaatgcattatctccttaatttctctctatctcattttagtcaatcttattaaatatgtcaattatttaaatcatcattccaaaattatcttttttttatgtctctatctacttaattgttttcattaatgtttagagagaaaataattaagtaaggatatataggaaaaaaataattaatgcatctagaaattaaaaaataatcttataaaaagggacatataaatttataaaattgatcttataaatatggacgaaaggattgctatataaaatatataacatgtcatataatctcatttatttttattttacaactaaagtataatattataaatctttttccaacattttttttataattgttagaaattgttcttataaataagaaaggctaaaatatatttgaaaaactatatttctataattttagaacctcaaggactataatattctctccaatcgatcttaagaatcaatttgatggtttatttttttaatataataaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatattttttaagatgtctttcatttttttatatgaaaaatgacaatgaaatattaaatgaaaaaagcaaatatacaaaatcagaaactaacaaaaggttttcgaaaatcttgtaaactaaaattgttcgatcctgtagaatcccaaagaataactgagaattaaaataattaaaaattaacaattaccttttcaaataattagaaaaaattcgtactacgtagaaaacatttttttaaccaagtcttatgctttgttgaaaaatgtattatacttataagtaaatataatatatatttttttgaaaaaaagtgttatacttatataataaattaagtaaaaataacaatgacttatatatgatatatgctatatttattatataatataattttttagttttacacataaataaattagatgagggagaaattaatagatcgagtattatgttaaatgtgatagtcaataataaaattcagaaaaattatttattctattggttattgaagatggagttattcaatcccattgttatttggaattaattagacaaatcctaatttttagtacgaataggtgaagacagtaacaagtggaatgctcgcaacactctctctaacattctcttttcaacaccttctttgtgattgactgaaatttttaaaattatcaattttggtgaatctaatatctaataaggagaaagaataattaaatgatacgttagaccaccaaaattaataatttttaacaaatttcaatcagagaatattaaaaagaaaatgctaaagtaaatgtggctagtgtgttttttgtttaaataaagtttgtttaatttcaagcattttcttcatctaccaaataaactcgatcttcgaaaaatttataaaatatctacaaattaattttcaattgggcaatgatcaatcttcccttttttcttagccatcaactctaaaattttatgaaatcaaatatctatatgtttggattgcctatgagaaactgaatcgttattaatgcaataacaaatttgttgtcgcaaaatattttcgtaggattttttgcttatggtacatcatttctaaaattcttctcaatcatattacctgtgtaaagcactggttgtttctaatattgttgagagtccaacagtttgcatttgtggcctattagatgactttggtttgtcatgagctgggccaagttttttgtcattttgtttttagttgtcaagaatcaccatcaacttcttttgggactttgaggaccaatcccacacgtatttctcataaagtttcacatctcgattaacaatcaacttctttgtatctgaattgcaaagtttgtgcctttgaatttatcttctagccaataaggatatgcatttttcttctttgttgtctagtttctttctaagttatctggaacatgagcatatgttatgcattcaaaactcaaaggtgtcaaattggtggtctcctttcactccaagcttgtttaggtgtattgtcacaaacacgtttttattagacacttccttaaaataataacagtaatgccaactactttcgcccaaaactttctaggaatttatttggacttcaacgtacatattatcatttccatgattgttcttttagcaaccaatttggttgaggtgggtatctagttgttagttgatgtagagcgatggtgtacccataatcaaggattaaggttagctacaatagtgcaaagaccataacaaaaacgcgatatattttctttgtcgtaaaccatattattaaacttgtgagtggatttttgaaattgtaattatcatggttttctgatcttattttttatttttactttttaatttaatctaaaatattttaagataaattatatatatatatatatattctaatatttcatataagtttgtcaactatttcttataaaatacataatttagtcatttttctataattttctagatcctaattttatattattttattacttaaaatattacttaatattaaaaaattataaaactagttcaaccacaattcaattatgattagatcattggtcctttaaatcagtgttttcacctgtttgattattggcgtgattttagaaatattgataattataaaacaaattgatctcttgaaattaagaaaataaaaaaatgatgttttaaatttaaattgtcaataaatttattccatctatttgttggtgccaactttttcttttcttattattgttggtgccatctaatgttgttaaaacaaggcttagttgccatgttaagtgcttagtttgacagttacttaaactttgttcttcttttttcccaataatattggtcttctaattaacacattagggaactatcaccaacaaaactcctgaaaccaaattgtgtgaagcattcatgattaaattatggaaaaaaaattgtaaccttgtcgaagcttgcatctttatgaacatgaacatgagtgttacagttacaatcatcaaaataataaaaaatgttttactaattaaaaaaatagagaacactcataaccagaactagatatctcgctaaagcatagtattcttgttagaatctggaagagcattacgaagactatccaaaaaaaattaagaaattttacaatggtaaaaatcaattttaagggcaaaaagaccaagcaaagagccgttgaaatctcttcaaaaacataaaaaacacaataaatcaggccaagtcttatatgaagtccaaaaagcagggttcacgagtgaggcaggaaagtttactgttagatttattaataaaataattaacggacaagattattgacttgttaccagatagccaaggaccttctttctcatcaactcttccccaccacccaccatttgttttctaccggttacctcaacatcgtcagccgctacggcttgatcaagagggtttctctctagtttggctagcacaacggcgctgctgcaatcgacgatcaccccttccaaagctttggcgaggtttactcaagacgcttccacgaccgtgccgcaacgacttgttcatcgatttggtgcatcccgaggtcgtgcaggacctcacttacacggtaaactttggaatctgaacttcgtaatctcgaagtgcaacaagcaaggaaattgactcggcaagtgccggggaccgttagagaccaaaacaaaaaagggtgatgtcgtgatgttgggtggtgttgggtttactcgacgagtgcaaagactattagagaccaatataaaaatgggtgttaccgtggtgttgggtggtggtgggtggggctagcgtggtgttggatggtgtcggcatggtgttgagtgtgcatagagataaaatagtctatagtggtagttcacattagacttggcctcgacgatggtggtggtgttgtcaaaaagtatttttttattttttaaaataaaaattattttttaattattttccaataaacaaccttttatcaccgatgattttcttgcctcacccatgaaccctgctttttggatttcatattagacccctgctttttggatttcatattagacttggtccaataaatcataagcgaagagccggagcctcattaaggtacccgttactatagttataatcgtatacgacacgttggccataacaaaaatactgtatttattatagtaaaccatatcgttaatcagtaatcaccaattcaaagtctagaaataaataccgtatctttcaaaacattagctttatattaatatttaaatttatgaatttcaaaaaaagaaattataatataaggagttgcacaacaaaatatacaacaacgagagagaaaaaagataaatttaaatttaaaatgtaataaatgatattataaatgaaataaataaatacaagatataatgttatataaattattgtagtattatttctctttgaaaatatcatcacaataacttttataaccgagttgtgaaacataaataattaaactgtttgaaaaatgtaaccacaataatttctaaagccaagtcatgtgaaatttaaataactaaatgttcaaataaaaatgtaacatttaaagtctacttcttcatgaaagtgattatgtgatagaaagagaaaaagagtcatgaactaaattaaaacaacatacatgatcatggtttcatttatccaatgactaaagttattcatctattggtcatagatcaagaaaactaacatttttcgtttctattggaatcaaccctgacaatttagtcccctgtaaccccaaatagactatgcatatccaattgaactaccaaaaaggacaagtataattataagtaaagaacacgacagggacagtaaccaaatttagaatagttattatatatacattccactacttgttcagtttttatacacaaaaagtgagaaatgatataaatatactcgaggtataatagttctccatggtacataacaaagaaattttgtatccaaatcagtgctcaactatagtcagccaaaacgacttcaaacagtctactcctcagctccacctatgtagttaaaggcagtccaatttggatcccaaaaaacatgtaaaatgaaaagaattaacaaatattgtcacagctaaattctccattttaaaaaatcttacagagaattagcatattaaaagaacataaacaaaacccatttcttgtattagttgtatagttgtattcctcttatgcacctatatatagctaaaaaggggacaacaacccaagagacagattactagcagatgctcgaaccagttgaaaatgaggcagatgatagactaatgaacgtagccttctctagtcatccttacttgcttgcatgccctttgaatcagggttcagatcatcatccaaattaagaaatcgcgattcttcccctccaccattataatcccctggctccactgtttttaagaaatctaatccataatcaacacctgaaggagtctgctccatattgggcaaacttcccaacaacttggcatctggattttgcaactgataaataaagcttgaaggtgtatcatccacctggggattaccatctccaggaaaacccatttgtccaaaatccaaaccttgcatcaaggcagactcatcaattgggttattatctataagccccaaaagttcatccacctgaaataactcatccgtggaaaacctgttcaagtaatcgtcactaaaatcaaagtcatcaatccatgacaagtccatctgatctttatttacatcctctgcaccctgcccgatatcatgtgttccttctggtctgacatattgaattttcccagccccggggtatatgtgatccacagcctcatccttaggctcttgcttcattatgctagttggtgaggcagcttcataagccttatgacaatcagtaaccttatcattcacattgacaagtcgaggattctccttaacatcctcagctgcacaaacctccgattggttggatgtagtagtagtgtcagatgttgcagtttctgccgaagaacaagaggacgatgcggccattgtggattccttcaacgattccttaacagaagcataatctgtgatgccgggaaaattgaggcgtgcacaaggaccatacatagctctagcagcttcatcataggcaagagcagcttcctgggcagaagagaaggtacccaaccaaagcctgcttcctctattgggctccctaatctcaccaacccatttcccccatgtcctctgcctaactcctctgtagttacactgagagttttgaggtcctcccttccctttcatgcaccctttcttcgaacctttagccggcgcctttcgagttgttctactatcatctttgccagaataaagatgttcgttgtattccttccactttgcaatagtcttagccacggatctagtcccataccctctgctcctacttttcctctttctagaagaatccaatggcttaagagaaacttgatcataagcacccatgtcaacaaatccgatacacagacttcgcaactcagtacaccgcaaaactcaatcactgaattcacaatctgttatagaagaagaagaaaaaaacagaactcttcagtaaccacgagaacaaaacagaacacaaaggtggaaaagtataaagaggatttcgcaacacgcacttattagccatagtaataaattcaaccaagaaacgaattttcgtaaaccccaagtaatagataaagctaaaccccaagtaatagaaataaaaaacttgctcagtaactttgtttttttctcttattttatatatacacatatatataaaaccctataaaagcacgacactgactaataaataacccagaagcagaaccctaaaaataaaaataaaaataaaaatttaaggaaaaccctaaacaaaaatcgcacaaaggaatttggagaatgagaatttagaaacagagttattaagacatgagaaagaatcggaagaatgctactaacctatgcgatactgacggtgtataatctgtgagagaacgcagcgtttttgggcttttctcttttttctagctagtgtgttctgttaggagtgaaaagagttttggtttgagtaaataatagtagggttcttgttcgtgaagagagttttggtttgggtaaaaatctctgggctggcaccttggaatatctatttatagccttctctagatatttctgatatttttaattgcaccccagaaaatggtgacgtggcgctttcttagtcgcgttatcatgcttcggagtcccgaagcagctggcacgtggcgctcgaaccttcccgagccactaaaacgacgtcgttttctttatttttccgtcttttccgttatgtacctctctttttgcgtacattctcaattatgccattgctaaacctttttattttattggataaagataaatatcttgtgacgttaatctttgctatgattattattattatatattgagcggaataaatcgaaggttgcagtttcgtctatgttgctgatgtctggaaagtgggcctcgtttaaacgaaattgggcccgtagcccgattgtacgagatctgcttgtttacctttaaattggtctagtagctttctacataattgagatataaatgacgggaaaaataacaagtgagtttcggtaaattataaaattaactaaaagtcaaccaattttttttttaaactaaaaatcaattttagaagagatggggagaaagaaattgatagttgaaacctactttaattattttttttattgttggttaaaatatttatttttaatacataaaataagatgattttctctttccactcatttaacataaataaggttttcaataaaaataagaaaatagcggtaaaaaaaactagaagacactcagtgatgcatgtgcaataaaataatagtgataaataaccatacaaaataagcgttattacttttttttcttccttctaggcaagcattattacttcctatgttcaacttctttttttatgttgaaagatttttaaatctttaaacaccgtttcattgattttgtaacaaaaaagaaacaccgtttcattgattttagaataaacacgaaggaatctgtagaaaattccaaagtggtagataccaaccgaatcaggtttttttgaaaatttgaagcgatagatattagctttatccggagaaataaactggttttaattttaaactatttattattgaaatgaatatgtggcatacatgtaaagtaggcacatgtcagctggagaatggattctcaatataaaattacttttttatttatttcataaaatagctataatatttaatttttaattaagaaagataacaaataaaaaaacagttaattacaatcttgtaattcccgtgcatgtccaactccaagtagtaaggatcaggcatatcctgtttcctacacagaagtgacccatgcacgtgagacacgtacaacttttatgtaagggaatggtaacacgtcatttctgacttgcggtttgattatatccatatccatgagtaccaaacctaaccgtttgatgaatggtggttctaacttgtatgattccagccagtggatgagaaaattcctgttgactgttgtgtagcggggaaccagttcgaaagcggttaataaatccgttcatgaatgatacagatatgctgacaacatgaatccagaagtgtggagccagtgagactcgtctttgacaacgtgttggaatctttaaactttttcttctcatgctaaaacaaatatcacacacacggcttctggataatttttccagcgtaatcgttatccaaaacataattaatgggtttatttatttatatagttttgatatataacatgtaaattctattaagtattgcgaggagtacagaaaaatgagaggaaactttattacatggaagggcaagttaagaagaaggtaatttttttttttgatgagtttgaaaattttaattgagtgagggagaacaatttaattattcaaataaatttaataggtggaaagtcaataggtgcattttaagatgcagtggaatgttctgtaaaaaaaaaaaaaaagttgtagtggaatgtgtataactcttgaagaactacactatcataatgagaaggtaaatgtagagatgagacaatttaacatctataagtttcattcgtgaatggagctatgaacctttgtaatataaacaggtcacatgaaaaagacagattaccctggccaaaagcaagagaagagaggtgtgagaatgtgtgcgcatttctattacagtgctaaaaaatctcgtcttaagcgtgtgctatcatttcattgtgtaactcttgagtgaaggtacctaagtttgtagaatgatatacaatttgaattgagttaattattgtgtgtttcatttaagatcttttggtcatatgaatgatttgggtgatgtatgttttattccaacattatgaaaggtcaaagtagaactaactttcaattataagagtgacaataatatcataaaaataatgtaaaagaaatttatctgttttagcaccatttttaaagaggaagaatgaactaattgaaaaaaaaaaaagagatatgcttgtaattgtaggaaatatcgtgaaaatttgttcaaacgtagaattcaaatttagaaaagaatttttttaaatagttcatgacctactaatgcattatgcccagaagtaaatgggtttgtgtaataaaagttttgcttgccttttcaatagaaagaatgcagacttcaacaagaatctaaagatatagctttgtgctttacccgtttcctatctttggtcacaaaagtaaagagttggggccagaaagtttttgatctttgggtcttattccttaaattacttgtacagaatggactaaatataacttgtaacttgttcacagaagtatttatatttttttaaaactagtctagagcacataccttttagttgtatcttaaaaaatatatataccttttttgtcaagcaattcatagaacaaacatatacaaaaaaagaattcgtggtcaatgaatctaaacgcacaaaatgatgtatgcatacgtgtattcctagttgagaaatcctcgctacttattgttaaagtagttcttcttgtacttcatctacctttagtaaacaaaaacacactaaaaaaatttgttcattatgtctcaagcaaacgtgtattgctagtgagaaatcctcactatttattgctaagtagttcctatttgataattgccaaaaatatttatatgagatatgtgaatttagaccaatatctcatctcttttcttatttagaactttgtttatgtattttttatgttaaatttgtgactttgtagttatttctcttttgtttgtcattttgataggttaaatttgtttatagataaattattttattggaatttaaagtgaattgaaaggaaactcttgaagtaagaaatgagaaaggttaaagtggaagattaagctgcaaaagggaggattttgcttaagccaagacatttttgtcttaaacaaaaacacaatagaatacagagaatacaaagcttcagaatttgcttaagcctggaacttttgcttaagcaaattttaattaaagtgtagatttttagagattttataaatagttgtgcttacctttttatacctgatcggtcttgctttgtaaaagcaactcctttgtgtaaaatatgattctttcttccactttctttcatcttcttccttccatcttacattttggtactactcatgagaatgagtagctagattttttcatagctttgggttagattgtaactaaatcttatactttcatatatttcgtttgaaatatgtttatatatgcatcttgttcttcaatgttagtgttttatctctattcttaatgcttgttattggaaaatactttcatatataacttgattttaggatgagattgtgattgaaaaatattttctttatcttgacttatggtagaacactcattagctttcagagttaagaataagatgaaagtaattggttatctttggatcattaagcttaaaacaagttttttttgtcaaatgtgtaagaaattgagatttaatagagaaatttagatcttttcactaagagtgtgtttggatagagaattttaattgggaaaagtaatttattagggaatttgaaattctttaattcaaaattcattgtttggatatttttatatgagaaatttaaatttttgaaattttaaaacagaattttaaacaactaaaaatgtggaatttgaatttctttctaaaaggtgagaaattgaaattctcttcttctctagaagctctaactgcaccactttttgctctgtctcaatctcggacgagtactctgacctccgatactctcatggcacccatctcatacgtttttctgtgcatgaggttcaaaattttaaaaacaaagaaattcaatttttttatcttaacacaaaattttaaaaatgaagaaatttaatttttttatccaaacacagaattttgaaaataaaaaattttaaattgatgtattttaattttcctaaattttaaatttcctaaaattttaaaatacttcatccaaacatactctaaagaaattagggattagaatactgtttttgaataatgactgatattaacattgaatttcaagttggataatatgcttaagtgtaaagagagtttcatttgatgaaaatctaatcccaacaagctttttcatttgtattttgtttgcttttaagcgtttttattttaaaacctcaaaaacattttaaaattgtgttgctctttaacatgttctttatctttgaatgtcaaattctatgttttaattgttttgtttgttagtttagatagtaaaaatttatgaatttatcaaatattaagtaagtcctagtagaaacgatatctcttatttatcaaatactatttgacgacttgatatgcttattaatgagtcaacactaatgtacaatctagatcatctaaatgagtattgttactgttgttggatgtcctggtttggttatgcttgattgttccctggtcctcctttgttagcatatccttcgtgtggcccttggtttgcaggtaagttcattttgatagttgattgtttgttagcatatcctttgaaaacactacgagaaaattgatataaggtcaagtttttagatttttgtgctatggtcaaaccaaaaaatttacattttcataattatttaaatattgtttgtcttataattttttttgagtgtaaaactcattaataatccgttcataataaagattatttataacaaccataacatgaatagttaatattattatataagttattattaataataacatgtctagttaataattcctacattgtttatgaagcaaaacaaaattattttatttgccttatgacagtgtagatcacaaatttttgctgcataatttgacacataagctcaggggttggtcctaagattttttgtgccttgaaaaaatcaaaagaattatgctatcataaatatttaaatattgtctgtcttgcaattttttttaccaaactcaattataatccattcataatcaagattatgtaaagaaatgataatataaataattaatattattctataagttattattaacgataacatgaattaatagtctgtatattttttcaaaacaaaaaaaatatttaatctatcttttgacataatagactgcaaatagtattttaacattttaaattttgatatacttcttttagtaccacaatgacatatgaataattaatattattctataaattgtacatgcattaggaaaacaattaaatgtcttgaaagagctcaatttcatgcataaagtttgactttgattcaaatgttaaattataatatatctaatgactttcaattctttaagatgggaaaaaactctgatttctcggacttagtcacgcttatgtccgtcatcgtggaattggtctccgcatttgagtgctataaaattgaaaatcaagcgtagtgaactgcctctccgacaatctcctccacaatcagatgacattactcaaagtggcgaaaaacactattacatcatatttgttcacgcttatctatgtgattgcgagctttgtcttgtcatttgccaatgcaacatccttgatcatcaaacacctcagactagagcacagggacaaaccgtgatattccgccacctcgacctcgacaaccatcttctgtgccagggatggttcatgtccaaccatctcccagatcaccccattgcatttaccaatgtggcagcatcatgtaagctacctcatttgggatcttggagaagtggatgaagctcgctctagtgaacatcttgatgcactatctcccttcaatcctttgagcgaaatttgacgaaagaaaaaagaatccatgtatcaaccccatcgtctccatcccgtaagaactaccagatcaccccaagaatgtcttggacatccaagagttgcagaccatccatagaatcctatttaaaaagtaaaatgcattatccgctttaagggtcgaagaaacacaaccactcattcttaaaaatcgatattcttaagagtaaagagtcagacaaaaaaaaaggatgagggcaactatctgttcccagttctcctataattatatcatgtagtgaggatttctaccttttttgtaaagcaattcattgaacaaatgcatactacaaaagaatttgacgaaaaatttaatacaaaatgaagctgtgttacaattttttttgtacaaaatacagttggagagacgtacgaaatgcagctagaaagacgtacaaaaaatcctagttataaaagtgtcagcctaccactgacacaccaaatgcagctgcagacattacactgagagagtcgacatctccaattaatacatcttcaaacagtgttttgtaagtacaagagattgaccagaaaacccacaacaactcccttttgggtctcttaaaaaattccttgatacatttataagtaaaacaaattcacccattatgttttcccaaagtacttgttatacttactattagaatgagatggtatgtcaattgcttactcctctattgacattcctcaacctggtcaaacatgtataagtatatttggtcgtctaccacaaaaagagcttatatctcaataatcacttcatcatttgtaatcattcaaactactattatttcataaatttgaatatatgatgtttaggctattcagtcttactttgatgaaaatgggtggtgttttaattttccaaaaccatttagtttatttatttattagacacatattattagtgtaaaaatatattttaactatcaaactaacaagaaattattcttactatgattttaaaaattaaaagtaacacattcacgatgtcaatttataattagataagtgcatgtgttatttatttttagtttttttgagttatgttgtgcttagtttattctttttttctgcaattttatcattttaagtttcaactttattctgaaaatatcttactcctaccatgttagtttatagtttgatgatcattgcaacatcaaacacagtactttcatatctgacaatgagtaaattgtgttttttttttttctttttaaacattgtattatgtttatctcttctgacacaaacacacacaaaaagacacttcgctttagaaaagatagggatagacatagtcaaaatcatatttcttaataacattaaccacatggggaagaaaacaaccaacatcaatttaatcaatcgggcttgtgaccatataagatggccttccgtgttgaaatcacaccaccgtctcttataaacccgggttatctctatatgaaaagaacatcaaaataaaagcaaaaggagaaatacctccaatacagggaaacaacaatgaactaggaaaattttggaactgaactatggtaacaaattcaataattttgattttgattatcctaacatagaggcagatcctcaggagggggctcaatggattgcaacaggcctactccattatccaccaaaagcacagtggccaaaccccacccgatgtgaacatccaagtgacaatgcataatccaagctcctgcacagatcacatcaaccaattatatttcattaaacataaaattgggattaaactaatagattaacaaacatctaatgtaaaattttacattatcaatcaatcaaaaattatttaatatatattttttatcataaaagttaataaatttacaatatgttttacagtttctactcatttacacttttaatgcataagaaatgattaaatagtcttagattattatgtgtccaccgtagtcctgactaatttgtatgtgataattttttttttaataatattctattacatgtcatgtgatataagtcgagaccttccaaaacatgtaatgatttctctttggtgcaaaatactattttgatttaagctaattaattttacctgggttgtcagcaacaaatctgataactgcccatccattcactggcacagccacagtgttcctcataggtggatcaacaaggttgaacttggaagtatctttgttggggtcaaaattcccgaacccctcagccacgatgtagaaatcatacccatgaaggtgaatggggtggttctcaggggtcacaatgctagtatcctgcaacacaatctgcaccctcgatccaaacttcaacttggtcactttggtcccttgaacaggttgccacagagaacgactcacattaccagtgtaatcaaacttgacaggaggctgcgtaggaaaatcagtggtgaacactccttgcactccaaggtgatgagcctgcaagattgaaacgttgtttgggagaacaaacgagacattgttcatgctggcagtgaaacgcgttccattcggtccctggcattggttcgcattgaaatttttcgggcaattgttgagtccaaggccaatggtgaagaaaagattgtcatcaatttctgcggggacttcaacttttctggggcttcttaagcttttgctgaatgcagtgactgtgttggtatcgttgtaggctggcagagacggcataacgggtttgatggacgagcctttcgcgggacacggggctgatttgtattcgagaatggcagtggtggtggtgttgtcaaagggtgcgttttgcgcggattggtaggcacgtgcggccatgtagtagcgtgtgggtggttggtcacctcggatgaggacatcggtggtttggcctggtcccagcatgatgacgttggtggtgaagggtttaaggtaggaggcatcggcaccaaccactgtgagcttgtggttggccactgtgaagaacaagggttggttgagtgctgcattgatcactcttaggaggtttgtctcgccagaatctattggaacaatgctggtgcctacaatattgccaattatcaacaaaataaatgtcgggtttgtgaaactactacaaataatgttctgttttcttagtttccaggatgcaggggtaaccctgtttcttggttcgaaagctttgtgtcttagacaagttgtaaattgcnnnnnnnnnnnnnnnnnnnnnnnnnnnncccccccccccccccaaaaaaaaaaaaaaatttttgctattttgttttaacaggggcgtgtgtcttttttaatatttatatcacattaagatattgagtttgttagtgtattagatgttatatttcaaaatcatgaattgttaatcaattggttcaatgcactctttaagatttcatcacaaatttaaagttattcattaaaaaaaaaaaaggagtcacttattttgactgtatatttttttttatctctctgctaactagttatctctgccaaaaataccaatttccattcctctaatcaaaatatattaaataaatatttgattttaaattttgatgttttttgccaggaggtttaatttgtctttcattactatatcctttttttttccaaaaaaaaatgtgtatgaaatataacctttgtaaattgtagattgatatattaaccgaccaacatagatgtggcatgttgatgagttaaatgaaaagtaaaatataatcaaaccttggctagaacacttgtaaagatcgccaggttgaccattgatggtgtatgcatcagaaatattaggtgctgctcctgtttgtgtagcttgtctcacaacatcgattgggtttgcgtcccaccactcccctaataatgttaatcattatttacaccgtcaaaccatcttaatcatgtgcataatatttgtccaaggaaaaatggaaacaacaaatccaacaatatcattttcttaatcatcccctccacgttttcattagtgccatcattcccaattatattcatatatcatatatgtgaaatacaatcattaccaagaagaattggtgtctcgcgctttggcttagtgaaaggatacgcctctccctctctggggtgaatgattaaagcaccataaacagtggctcttagccatgagctatgagcatgccaccaaagtgttccttcttgtccttgaatggtaaaacgataggtgtaactttctccgggacgaatagggcactgagtcacaaattctggtccatcagcccatcctgttctcatttgccgaattccatgcctaaacacatacaagaaattaacaaggatcaacaaaaactaagtcactcaaacattttttccttcttctaaaagttccatatatatgcatgtagcatgcaatatatatatatatatatatatacacacacacacacacacgagtataacgtgccttctataacttatcgtttggagacaagatcaattaaggcctttgttacatttaattctcacaagtgcataaaaaattaaaaagaaactttttttaagtatacccatgagccgtgagcacatgttaaagtatagaagttatctaatgctgatttcttttaaaagagaaattgtattggtacagaaattttgtagtaaacgtaaagatgaaaagagagagaatattaaataagatgattgacgtcataagaaaaagataaaaggaagaaataatgttatagaaaatataatatatgaatttgttgtacgaataactgttttttttataaaataattaatgacatttaataaagtatatttaatggtgaaagccgaaatgctaggttgctttgatacgataccagtgaatagtcacattgtaacgagctttgttagtgactttgacgaccaaagtgtcaccattgttgacttccaatgttgggccagggaattgtccattcactgtgatggtgctgtgggtgttgcacagcctcttcactggcgttgcttgaatctgtctcgttacaaatggcaataaattaattttcttagcaagaaagagaaagagagagaaaaaaaaagtgagggaaagataacgaacaacaaactcatgctcctggattttggcattggctgaatacaatgctgaagccaagacaacaaaaatggctaagaagagggtcttgagagcttccataattcttctagtgtgtagcaataaatacctatgtgccaatgatggttaaggttgcaaattgcaatggaagtgatagtgggagaaggatgcttttataggggagaacaaaggagagagcttgagtcattcaggttggcagattaggtaaactttgttatggcaaattggtcagaggcactcttaagaaacttaattcaaccctattaaagttgttgcacccactagttaattacgttcctgaatgcttgcttctcaagtcttcaatttggatgttgaattttctcaaaacatgattactttgagactgttcaggaatagaataatttattaagatgagtttagaataattgactccttttccctttaattggcatttaacgccgtacaattacatcctcaactttttcattactgtaaaagtattcgacatttcaaagggtccacaactaaaaagcatagcaaaaaggttttttttttacctttgctgtccaagtcaagttgtgtcctatgcatctttattgtcaagaagttaccatatggcctgaaatggtttgcctatagcaaactaacatgtaattctgtgcaagtaaacttgccccgtcaaacatattgcactttgtttttatctagtgattcttgttacttcggattgtgtattatttaattgtaagctaagtttggaaagtgaagaaaagtgcaattaattttgtgttagtccaatttgacttctttttttctggtttcggtggttggagaaaataaatcacttgttacaaagattgataatcgctttgatgaaaaagtaatagacattaaaaacaactatgacttctgaaaacatagtctgccctttatttagactaaaactctctgttttagaatgctatcgtcacttaaatatttccttgattgatctataattaagcattaaatatgttgaagaggctgtttcttaagctctcgatctcatgttaggctaattttctttagggtataccctcacctcttttgtttctctaacttttcaagtggctagttgttcaagaattcttatgttagactaaactctctgttttacaatattatcgttacttgaatattgccttgatctataattaatcaatacaagattaaatgttaaagaggctgtttcttaagctccggatcacatgttaggctaattttctctttagggtatgccctgaccctcttttcttctccaagttgttaagggctagttgttcaaagaacgcttatatgttaggatatttaggctaatagttttgtttaattcaagtggctattgataggaaagaaactaacattaaaaatgtaaacaattaacagtgctgccattaggtacgtagcaaataaaatggggtagaatatcaacgtgatttgattgggtccaacacgaatttagttagagatactcatgaaaaaattaggtggcctgtctccctatatttgaaacgtggattatcaactgggaattataacacaaagcctgcagtcatactcaagaatacgtacttggatgtataattatcaatatatatcatcactttgactaacatcatcagggagtgatcaccatagcgccacatgttaaacaaaatatcactggtgacgctttttcagatgtttgactatgtgatggaggatttggtttcctaatgatctgtttgttatgtaacgtattttcataataatatagcccattcaattattaaaaaactaaatattaactaagtatactgatttctttcacaaattgaaaaatatgatgacaaattttatttggtctaaggaatgggttagatttgtctagaacaagacaaaatttgaacatggcaagtttatatatacttaaatgctatcttatagttgcatctgtgaattagctactttggacactcacaaggatgagaaccttcgatataaaaatgctttgacatagcaaaggacacgctaaaggttggacaagtctcttttagaattcgtggtgacacgaattcgtacaatttataaattcttaaatctcaagaaagatatgtggaacattttcctctagcagtattctcactctatcttcaatagtgcctttgattgagttgataacaacatctagccaaggcctcaaaagattattttggtttgtcacaaaaccgttagatgctgagaatgaaagcatgtcaattaatggaggctgagtgtgacaaagcttaacacgagatagagaacccaaatgaccaattgaataggtgaacaagaaataaagaaagaacatcatatatgaaagttggtagagtttgttactgactttctcaaattcttgagatggaaataataggaagtacttcaaaagtcgttaaacactgaaaaaaaaaaaaaaaagaagcaagaaagcttaaaattgacacaagagcagaaatcaattccttgtcaaaatttgctggtgcttggtctctctcgcaatagcttttcatttgtctggtaatataattatttctcaccttctattaattcttgtttgggggtgtttgatttcttggattttcatggttagttataagtgggtgcgaacttgagcaattttaattccaccgtcaacattttctctaatccaaaataattagagagattaaagaaattaaactaaacagcaaatccatcatttcttcggtatagaaatggggccttcttaaagaccacgctcaaaatgatatgtttttcctttgttgtaaaatgcacatgtaacggtaatgaagccataaacacgagtttggtgagagaataatccctacaagttcatcgaactcactatgatgctgtatgaacttttatgtgcatgttccatgtgtgacgcatccagcacccctagctctattgacgtcacaaaagacaaaaaatttctcaaggctggttggtgtacaatggacaaatcttatacacctagctattttgtatcataagaatcgggcaggaattaatctcatctcaactttgttaactaactgaattgaaagcttgatttaactagacaccaattagcatgttttgacagactctaattggattagaataagggaaataattgagtaggaatatttgaacactccatgaatctaagggcgctgtttgtttctcttagtttttaattttaaaaattgcttgtgacacatcatattgaagtattcaacccaaaaaaacagccttatttaaataatataattatttatgaattcttaaaattgtcattaattgtttttttttctctaaaaaaaacaaccaaaagaataacaaatggggaaattttccattgattattgtaccataccttaaacaaagttaaagcaaattgttgaaatactttattcacgaatattatgaatgaaagagtaaaaccggaaaggtaaagtgccagtaaaatactgcttttacatatacatgcaagaaaagataaatggagtactgaaaacagaaggagggacgagctagcccagaggatgagcactgagtgagatcagcagatcgccaatatacaattaagcaaatattcatcattcatagtcattgtcaaaaaggaaaaaaagttaaaaataaaataaaacaaaaggttgaaacataattgaggcctttgcacacatgccatccaccttcctaatgatatctcacatgcatgagtcacattttcttctttgttaaccataagttcttaagaattgctggaagaagccaaaaaccatcataatcactactccaatgacttgtgatttgtgagttgtgtgtttgcactttgcatcgagcagatctataagttttacccctcttctatgctttttgtcttattacacttatctcttcacctttattttcatctatcactgtctttgtaaatctctccctccaaattagcctgatcataacggatatataagcatcttaagttcttaatagcagtgtcatctttatgcgttgtgagatagaatagaacattcaatgagtcaggcctgctaccttgtgctattatcatgcatatatgttcacatatatcatctccagaaattttagaaaaatcgcttctggtggattttgttctaaatttggagtggagaaaagccaatttgactattagtcatatcagtgtgacaacttgccaaacaagtagaagtccagcaagtgtttttctctagcacaagctcaattatttagagtgacaaaaatcattcatgcccacttcatttttatttttccataggtctcttccttcaaagacaattctatttaagatatgatcggactttaaatgtggacatctctctcaactaggattcgaacctttattcaccattagttccttccgctgaacccaactattgtttttcatgccccttcgctgattaattaccaacatatatcagattatcaattcaaatccttttctttttatcgagtaattatcaattgaaatgtgaacatactaatttgaacactaggaataaatcgtagcagtacggtactatttattgagcaggtatatatctgtgataaagggtaacttattacttatccggttatccctatcctatttataattttgaatagagaaaacatatttattctaagtatctaaatccattttattgtaagttttatcaatgaacatatgcgagtataaatttttattctattcctaaatgagtagttataagtggataaaattattaacaattcaaatctgtatagtaatcttttgaataacttttctactggcaatcccaacatatgattaacattctgtattaggagtaactaatatcccttttaccacttttgtttatcatggatgtactaattacttatgcaaaatgccaagtcaataaccaaatttatgtaatgttccatggttattggattaggcaggttgaacaaaaaataaaattggtcagctgcaacaaaatgttcataagactgtttgatgccttatcaatggattgttatacataacctcaacttggtttttatttccgttgtgttgcgggagggtaaacgtttagaaaacaaatttctgaattctgaaaaggtgagggattttaattagcaatttgggatgccaatagtaatgcccatcatctttccaacgtagtgtggtttagtttaatttgggccccaacttgttgaaaaagaaaaatagaaaaccattgcaacaccgaagtaatgccatatcctccaactttgtaagagttcttagatgaggataagtgaacactgctaaactactaaactgtgacattaattaaaaatacgaaaaggaaaaaaatataagatacagaagagacctgcacaaaatagaataacttacccaacaagaaaatgaggaggccacaccttcaaaaaaatcaaacaaaaacatttttgcttaatgcttcatctccgaagtaacattctttgaagaattattaaactagtaacaagaagacaaatgtttcatttcaaatcggcattaattaaagtaaacaccttcacatgctcatcgtttgattgcccatgataaatgtactaattttctttctaagattctgtaatgaaaatgtcatatcctaattattgctatcattaagagaaatatactaaataaattcataaacctttagtcctatcaatgatgacaccctcaatagtaggggtgaacgtgagacgagttgagacttgagatgggataataaaaaattggttagggtcagtttctcgaactcaaaattcactcggtaaattaggaataagattgggttaattcgatttattattataatatatcattttaacattgtgtaaaattaaattgtaggataaaaaaagaataaaatttaaattaagatgtattttataatatatatttctattacgactatttcctttagtccaaaataacataagatcgagggtctcgaccgaacattgcatacactaatcattatcttattaatatctaggtcagtgattttcaccctataaataggagtatatctcatggagaaatgtacacatattctaactctttcttttccattcacacatagcacataccacataccaattgtgtcgtgttctcttttgagtactttgatcatctttcctgaggtgtttcaccaccataatcatcctcagaaaaagagagtctgatcccatattaatcactcaacaattctcgttggacattcctattcatttagaacggaacaatttcaaaataaataatatctttataataatatctttataaatataataccatgttatataaaatgttatccattaaatataaaaaattgttaaaattatatatatttgttcaaaaagcttagattttttaaataggaccgggttagagtaacttgaagaacagtttaacttcgtcctcaaaatatactgagtttaattttgaaaacccaaacttgtccaattcaatttatatagcactattttctaaagagagatttatagtagattttttaaaataaaatgaagagagaaacaaagaatgaaaatataaaaaaatgcattaaaagaaattaaatctctgacacatgtcttaatatttaattaactaatttgtttctgtccctaagaaggtgtgatttataagcttgtttgccttttcatttaagatgatattgaatttgaataattgagaaaataggttataaagtagatttacacacagactgttatctttttctttcaacttaaatatactttaactatcttatataactcaattgataaataaggatatgaattattataaatcttttaatatttgaattatttatataattgagtagcataatgtgagtttagactatcttatgaataaaaaaaaatatattaattgatttggggttagactatctttcttatctctcatagttaaaattacaactttgtttcataaatatttataaaaaagaaaataaaaaaagataaaataaattaaactttctcataagttaaaattaatttatatatttaatttttgtaaaagttctttcatttaactctttcaaaagtttaagttatgggtgaagtttaattttgccgttacaaaccatcttccttttatctttatctccatttctagattaaattttaatatagcaacaagttggtgggttaagtggaattaatctcgatttcttttggcaaagttttaaagttaaattttataaataaaaaaaatataggaacaacaaactccaccaataattacacaaacaacaaacataaatagtcctaaaaacaacaacaaaaaacctcagagtaaaaaataaccacacaagaaaagaacacttgttagagtatatttgaaaatcagataaaaaataagacaaaaatactttcacaaaataatccaaacagaatctttatttttgtttttatttttattttatctattgaatttgtattgaaacataagccagaatatttttaattacaatcaaacatgtaaataatccatctaaaaacactggttttggtttttccaatggtttggcttggcttctttcgtatcaaacgcgtgatacacaagacaaacgcgcttctcttggtggttagattaggtagcaccggaagccgttccttggccccattccggcattcctaatcctatcatattttttcttacatgcacgagttgactcaccaactcgttcactcttcccttacactcatgactcaactctccttcttcttcaaccttccctcatcatgattttcaattctctttcctcataaccagattctccaaaaatgatgaatcacgattccaacaacgaacaacatcagattctccatgtctcgcaggacgacgagataatggaatcgctaatcctcgatgacgacgacggctcttccgttcagcagcaccaccgtcctacgtcgccgcagagccctaattcccctttcaactcgttcctcgaccctccctcctacgccgacgcgatcttcacctctttcgattccaacggtcacgaccaagccatcgaatcccccgccgcccgatccggctccgaagactatctccacatctccgtcaccgatcctgagaaggagcaggacatcgccacctccctcgtccccggcgccgccaccttctacacctacctcatcaccacgcgcaccaacctccccgaatatggcggcgtcggtgctgagttcgccgtccggcggcggttccgcgacgtggtgacgctctccgaccggctctcggaggcataccgcgggttcttcatcccggtgcggccggacaagagcacggtggagagccaggtgatgcagaagcaggagttcgtggaacagcggcgcgtggcggtggagaagtacctcaggaagctggcggcgcacccggtgatcgggcggagcgaggagctcaggttgtttctcgaggccaaggggcggctgccgctggccaagaccttcgatgtagcgtcgcgaatgctcgacggcgccgtgaggttgccaaggcagctgttcgggggagaggcggagctgggagaggtggctcagccggccaagggcgggagggacttgctcaggattttcaaggagttgaagcagtctgttgccaatgactgggttgggagcaagcccattgttgtggaggaggataaggagttcatggagaggaaggataagttggtggattttgagcaccatcttagcaatgtttctcaacaggttttgtgtttcatggttttagctttagtgtttgttagttcaccatggtgcattttggcaatgagcttaactatgtgcttatttagtaagttcatcataagattaactatggtgcatttgggtaatcagcttaactaagtgcttattcaataagctcattaaaagtttaacaaagtgcattttggtaatgagcttaactaagtgcttattcagtaagttcattattagctttgggcttccatgttcattagttgagtgtggtgtacttcctctagactcatatataagcaaaaaaacggtcttgtatgttggacttaaatataagcaaatctaattaattttgtcttatttaatgttattattcgtacaatatccttcatttaattctaattctatttcagtgactcctttttatttatgatagtaatttccaatgaagggcattttagaaataaccttattttttacttgagattaggataattaaatgatgtcaattaactttcttaattagtgtgaaattaattatttttgcttatatgagtccagagggagtatttggttagtgagcttaactaagttgttattcaataagcttacatggataagatttagtgaacagtgaagattattaaaagaagttaaagagtttataagaagctttaagttgcttttgagcttaacctaacacctgcttaggcacttaattataagatatgtctaaataattctgtaaaagtacttccaaacactctccgaatgcatgtttggattaagcttattctggggggaataattggtttttgatagcttcttgaaagagattttgaaaaattatggttacttgattgaattgacaaacattcctcttcaagtgttgctgtgattattgaattttgtctaaaatgtgcccccctatttggaatttagataccatgtccatttttgtcatgtggaactgaataaggacaatgttgtttttcactttcacattgccaagcttgattttgtttatctgcattgacctgcaggctgaatcccttgtcaagtttcagcaagacatgggtgaaacggttggtgaactaggtctggcttttgtaaagcttaccaaatttgagacggaagaagccatatttgagtctcagagagttcgagctgctgacatgagaaatgtggcaactgcagctgttaaagcaagcaggttatatagagagctgaatacacagacaatcaaacatttggcaagtacaaatattcttgtgacttatgatagaaccttttagcttctttataaatgtatggtggtggaacatgatgatagatgcgttaacctcctgatataatccctaactattttctgttgttgatgagtagtatcttctttatgttgcaggataaactacatgaataccttgggaccatgctagctgttaacaatgcattttctgacagatcaagtgcattgttgactgttcaaacactctcatcagaactagcttctttacattcacgggtggaaaaacttgaagttgcttcatccaaaatatttggtggagacaagtctaggatgcggaaaattgaagagttaaaagaagccattagagttactgagaatgctaaaatttgtgcagatagagagtatgaacgaatcaaggtaacctttgattgggttgtcctatcctttctttggcatatgtaacttcgacttttgagcttttatccccctgcatattaactcatttttccctttcagaactgacttttccatattttctttgtcatactatataatgcatgtctccatatttgtcatatactgtagatttttgtctttatttgcttttgttgcatgtgtgcagttatattaatgtaggagaagattttactcaacataactcagtcaatgagtttgatatagtatagtcactaaattttgaacacccttacatcccttgtggaaaaatgacgagatcctattaaattatcataaataaaaattagtattttttcactttgatgataaatttgactctaatattttcactggattttcttgatgcctataatgcaagtgtatttgtagacaagtgtcagggtgaaagaaaaaaaagactataatggtggcaaagctatatgttgttgcacttaaatgtttcatttagggctgcttcttccattaataatgtcaattcatagcacattttgtaacattcaattttgatttctagatatattgccatctcaatatggaaaatccaatgtttttttagatcagactaataatatcattgaagtagtgaagacattattggctcatggtttactagtcaaaccatggttgaatggtgataattagataccatttttcatattatataatataattaataaattaacatacaatcatatgaaatcagattaggtaagttttaaattaaaaggacaatattatttatgtcttgtagaagcaattataagaggttgaataatcatcatcctgaaaggccacatggaagcaaaggatgaccattatattactcaagagcctcaaagtcctacattggacatggagtaaaacatccaagcatacaacacacacacatatatatgtatatatatatatatatatatatatatatataataagagataattacatgaacctcccttgaggttggcggtagttacccttagatactgtttgtttccaaaattacacctacctcccttgtgtctcttgctttgttaattttaagataacgtgcatggtttgtacttaagaataaggaggtatttgtaatttttaaaaataaatggtctttaagcataagaataatatataaaataagggatgtaagtgtaatttctaaatcaaggaaggtttaggtttaattatcactgacttcaagatatatcagtgattcagtgtaaaaatatccctatatgcaaaatataaaatatatattataccccacctagtgggattagactttgttgttgttgtataccccacgaggaagctttactacaagtcccacacagtatagtgagtggaatattcaggcatacaatatatgtaaaggctgatgctgcattcggtatagaggatagaaatagagaggatggaaatagaagacaaatatttgaattaaagtaaagtgtaaaagatatggaacccacataaaatccacattatttctcccctctttctctcctcccctcaaagggtcaaacaaacgcagcataagaggtaggcaagtcatttcatgtctaaaatatagcgtaagaataatatttaaataaggaatgttagtgtaaaagatgcgaaacccacataaaattcacattatttctcctctgtttctctcctcctcccctcaaacaaacacagcataagaggtaggcaagtcatttcatgtctaaaataaggaatgttagtgtaagttctaatcaaacaaggtttaggtgtaattacccctaatttcaagagagatcagtgtaattatccctatataggttttgattgctccggtttgatgcagagtgaactggacaagggattggttcactggtttttcaattggtctggtctggtcatgttcttgttcatgtctccatatttgctttcatttcatgtgtacagttatattaacctagggagaagatttgattcactaaactccttttcaccccttatggaaaattgacaatgcgatccacttaaaatatcctaaatgatcataataagaattatcatcattacaccttgataataaattaggcttgttatctataacgcaagtgtatttagagacaagtgtcagggaaaaaacacacagaaagagactggaatagattcaaacttgatttctatgtccattgtcatctcgatattgtaaaatccaatattttaaaaactgggtttgtgtggttatggttcactggtcagtcggatcattgttgtgaaatattgctgggaagtctttatcatggaatattgtgtcaaaatatcacttgtgattgtggaatgtttgcaggaaaataataggagtgaacttgaaagaattgaccaagagaggaatagcgacttcctaagcatgctgcgagggtttgttgtcaatcaagtaaagctcatttatcttctatgttctgtaagctgttacgtttaattggcttttatctttcgtaattcagaacagttactattctacttcatccattttacaggcaggctatgcagagaagacggcagctgtgtgggagaagcttgcggaagaaacagctgcttactcaagagacagcagctaaaatgtacttggctgtaaattcttgtttttgccttttctatgcagtaattctagattttggttccattaatacaatcttatgtagttaaattactttagacgaacttagttttagcccagagttgtatatgcatatatccttttatttttgtcctacattcaagatttcaatgagtttaaactaatcagagttgtacatttcttgcatatatctttttattttcatgttataaattaatgtttaatttttgttgtggacgcagctgagtatctaacccttaatgttttccttagatttattggagagaaagtagaaagaaaagttgacttgaattcataatttacttttttcaatttaaactataaaatattttctcctcccttacaggtctttagttttaacttttaatccgaattatatatattcttttattcacatgtcatatatatcaatgttgattttattttttttgttatggacctacgttgtccttttaaagattgacttatgttaaaacgcattaaacttggacatgagctatttgtgccgttgatttcaccgcagcaattatctacgtatgtgacgaaatagaattaacgcaaacgggggagtttagttggtggagaacaagaactagtttctattatgaaatgaaactaatgaagtgttaaagataacactcgctgaaagcaaagtactatgtacaaacactaggcactccaaacaggcaaaaattaatgtaagaatgaaagaataatagattgtcctaccctaccactacactacaatgttagtcctaaagagaagcgtaaactcaaaaattgtccacataacacccaatattcattcactagtcgaagggatggctccatcgtcacccgaactgactgctgatatctctggtctaatctcttcaagctgctgaaggacttgctgaacttctggtcgtgctgatggagaaggatcaacacagtgcaaagcaagcttcaacgtgttcagcatctcatcgccgtatgttgaagcatctctcatcaactctacatcaaaaacctcatttgtccactcctctttgacaatggaggcaacccactgaggtaaatccactccattcatagcctcaccaggtggcttccccgttaggagttctaacaagatgacaccaagactgtatacatctgtttttgtgttggcttttttcagcttcgagagctcaggtgctcggtatcccaatgctccagcagtggcaatgacgttagaattagcagcagttgtcatcaaccgagaaagaccaaaatcggctattttagcactcgcattctcatccagcagcacattgctggacgtaaggtttccatgtataatgttctcactggaatgaaggtataacaagccacgagccattccctgtgctattttcatccttgttggccaatcaatggctgtttctggcccacgggctgcacaaaaatggaaaacagtcaaaacaatagtgttaagatattaaacaaatattctaccatggaaagaaaaaataatcatagcaaacttacaatgtaggaaagaagcaagacttccattaggcatgtaatcaaatactagaagcttttctcctttgggtcccaagtaataggctcttaatgccaaaagattggggtgtcgaattcttcctataacactaacttcagattcaaattctctttgacctttagtgatcttttccctcaatcgtttcactgcagcttgacttccatcctctaatgtagccttgtacacagttccatatgtactctttcccattatctctgctgttgcacacaagagatcatcagctgtaaaggtcaatggtccatcaaaatggactagtttgcctccgacctcgccacccgcttcggctttgcctgcaactggaggaactcctttttctgtcatggcagcagctgctgcagctgctctacctgtggcctggccaccctcagcatttgatgttgctctttttctgatcaagcagaatagcagaatgcagcaaattgttaccaggactacaagaagcactcctgctactatgagaattatgtctttggtgcctaatttcttatgatgacggtgttctgatatttcgggaggtgaaccagaaggagctagggagggacatggggttgaagggctatagccacatagttgaatattccccacaaatgagctcgagttaaatttttgggcaagtagggtgggaactggaccagagaggttgttatgtgaaacgtttaagaaactaagactatgcagattatcaaaggcgactggaatttctccactgagattattcagtgacaaatcaagctgcgtaagctttgaaatgtttccaatattttgaggaatgtggccactaaattggtttctgctcagaactagaacagaaagattatgcaatctgcctaaggcttctgggatttgattaccaaggtggttgttctctacattcaagagagtgagtgaggaaacattagagagagtggcaggcaagcttccattcaagacattgttagaaaaatccagagtctcaagtctagaaaggtttcctatttcatttgggatagctccactaaactggttatgactaagagaaatctctgtaagttcactcaagccgcccaaagaagcaggaatgcttccactcaacatgttatgatctatgatcagatttcgaagccgaaagaagtgatttttcaagctaccaccccatgagttaggaatacagcccgagaggttattgtgttgaagagataggtaggtgagagaagttaagcgagtcaagctagttggtattgggccagacaaggagttaaagctcaagttaagccaataaagcttagtggcattcccaaggctcatggggattgtcccagtgagcaaattattgctgaggtccaaagactgaagcaaaggacatgaccctaacgaaggagggatgttccctgtgaacctattgttgaagagctgaacccctcttagattgagaagaagtccaagtgctgaagggattgaaccaccaatttggttatcatgaaggctaagctttctaagccccctaagttggccaatcctctcagttatgtgacccttcaaccccttccatggaagctggatcacaatgacctgtccctgagcacacttgatgccaacccaagctccagaacaagctccatagccactgtcgttccagcttctcaagaagcctttgggatcaaccagctcttgcttgaacgcttgaagtgcttggaagtttgactgtgtcacaaccaccccatcccaacgctcttcactcaccactggcaccatgagaatccacaaacagaaaaacaaccggaaaaaatgacttgggttgtagtaaaaaaaacattttgaggtcaggttcttgttctccattgcaaacaaaatgaaatatttaaaaaaaaaaaaatagtaggagaatgaatgaagcaagaaagaagtgaagagaactaaagaagaaaaagtaggagactttgattgattattacttggtgagtcttcttcttctctctagtagtagtagtgtccataagacacacactgtgattggtattgtgagagagaagtgggcatagaaaactaaaacaaagaggaacaagagttggctgaggattttgtaggaatgggaagagagaggaggcacgtgatggtcataagagagatagtgtgagtggggcgcgaggggtgaggaatcttgtgttgggaagagagagcaaaaactgaagacagacaattatcaggtgggtgtggtggtacagtacaaccctccctcttgcttcttgcaaagacaaacggctagttttttttttttttccttacaactatgcacatttatttgttcttttcttcaatgtagatgttcttgtctgtccgcaacccaaagtcccaacggctatttcttcttcatcgcagtgtaggcccaccccatttcagctccggaccgcaaaactacaaaatgctgccaaattactcacttacccctcacgcttcacctgactaggtgtggatttggatttctggtacaacttccgttttccagaagcatcatactcttgcttttgtaaaatggagtttatcaaccattagatttatcttgaaatttatgcatcatattttgaatgaacattcaaacataccttacatgaatctgatcactcaacatcgccagaaaacttatcatctgttcaccctaaagttaaattaagactttaatatgtttttaatctatgtaaaattggtaagttttgattttagtttttataaaaaaaaaaattctaagaaaaacggaataattaattttagtctcttactattatatgacattttttaactgtttatctatttaataaaatatcaagtgactatttaggtaggactgtttattgtagtttttttcttcttctaaattcctaaaataaatatgaactatttaccttaaaattaaaattagggacagaaaatagtaattctaaattttggagggataaaagtgaaagaaaaagttcttatagagaccaaaatcaaaatttacttattttataaagataaaaatagtaatttcaaatttaaggaaaataaaaaaataaattttttatagataccaaaattgaaaatcactgattttaaaaggatttataatatatttaaaccaaaattaatttaagataaatgctacaactatacactctttaatacattttccaatcatatttttttaatgattgaaattcatgttcatgtaggtctcattaaatgagtcatatttctcacttgatgggtcacatcccgaaattagtaagacacatggaattttatcaatgagcgttgaaaagagcaagttactaactctccacttgatttaaatttaaatggtgaatgaaatattgtaaaataaataaatctaaatcttcttacgttttatagctagtcctccattgtattgtagtacttaaaattttatattttgaagatatcaaatttatttactatttatttaaatttttaatagaataaaaagaagatttgctttccttttgatttatattgaagtgaaataggcctgttaaaaaattctagttgggctaaacggttcataactgaaccgggcccaaatatcaattgtccattcatgatagctcgttcacgttacctcgttctgcgttctccttcaacacaaccgcgaaaaccttaactcagagctcgttcaccatacctcccaaatccattgtccaaaatcgcggctcaaaccgaaaattcgaacttgaatcaggtatcgattagaaatctcgttgcaatttctgattttctcatcgattgtgattgttcttacatgtttacaaactgatagttcaacttatactgtttgtcatatttctgttcaggaattttggggcaaggttgctagtgttggcaggattcaggattaactatagttcaaacctagtaattctcgctccctttgattcttcgcaaacttattctaattgttttgtgattttttttttcaattcagcatttgactctgtagattaatattattgtttgagtgagtttgcttttttgatgtgagatatggagataatttttctgcattcatttacagtttcaatgttgcgataccttggctcatgttatagttggcatttttaggtttaaacttaagagaattaggtacattggatgcagaattaatttattgtttatcataggagtggtatagaaagagagggaattcataattattggtaacttggcatgggaagtcatggtaaattggtaatggcaactggcaagcaccatctttctttaggctttagcatatttgccaaacctgggctttgaagaatgggctacaagcctacaattggactttcaagccaggtaccttagtgtttttcctctgtctttttggcactaaccacttcttatcaaccttcatgttaacattacatttcaacggatgaaatgaccatggtcttgaaagttaaaaccaaaaggaaaagcaaagtaatatctgtattgcctactagtatacaaggtagaattttccttgcctactagtatacaaggtagaatttcccttgcctactagtaacaacttacgagcttttttgatatttgataataataatatagtctgcataatctgcattttaatgtctttagttgttactattggtaactggcatgcattgttgtgtgtgtatatacagtcttcctgttaatgcatatagccacccatttaagacgtgggctaattgtttcttttaatttagtatgctggttctaacccactggtgatggtctatattgacagcaactaggtttcaaaaactaatctctaatctgtatattgattattgaataccagatagtagaagaaaacgaagttcagctggttttatttgatagagaaaccactacagaaatatggaagaggaagaggtgaatcgatgccagatacaggaatggtatccaaagttcaaatctgtatccatcaagaccttaattcatcaacttcctgaatcatttattcagtaccttcttgatgactcagggcccttcctgttgcctgattctgtcttaaatgaagatgcattacccaatagaattcataacccggatgaggaagaagattttcaggtgtctgagggatctgatgatgaagcagaagcttctccaccaccttcttttccagaacttgaattgaaaattaaggactccattgagtcccttgggggtgcagtcttccctaagctgaattggagtgccccaaaagattcagcttggataagcacctctggtacccttcgatgcatcagtttcagtgagattgctcttttatttcgagcatctgactcattggtccacgatttgtgccatgcttatgattcatgccagaataaatcttcaactagaccccagaatttctttcttgctctccgtaaatggtatccatcccttcagccagacatggaatttcgatgttttgtacagaaccagaaattaattggaatttctcaacgggaggttactactttttatcctgttttgcttgaaaagaagaatgatctccttttactgatacaggcatttttcatcaatcatgtgagggctaaatttgagtcagaaaactacacatttgatgtttacattacaaatgatgacagagttaagattgtggatttcaacccttggggtgcatttacattgtcattgttgtttacatgggatgaattggaccatattcatagtgaaggaaatgatgtggagtttagaattgtggaagatcgttgtgctgttaggccaggacttaaaacagcagtcccatttgattacttggataccagcccggggagtggttgggatcaatttctaagaaatgcagatgaagagttaagacgacaatctacaggagctggtgcatgataatcantcaaaagttttttttttttttttttttaatttcattttgagagttttgacaaagaaggtgaagacacatctttgaaaacattaccccgtagaggatgcagttttccttttagttttagtctttatggtttataagttttttatattggactcctagttgacattgtaagttgtatccaaatatcaggcctcagataatttaatgctgaaacttcagaggcacatggagagctgaggtggcaattgtttatgatgaaaccaaattatcttcccttttaaattttcatatggagaaaatatatcatgtattggttttttgtattattcatgtgcctacttttgtatgtttctttcactgcaaacacttcctaatgtgtctttgttgcatctctttggcaaactcggtacataattctttttgggatcgtacatgcatagttgatcatttcaagtacataactcatttatcattctatattaataatctatacatgatcatttaataattttgttcatgtgctttgtgtttcgtatatagtatatatatgttcatcaccaatctttttttaaggaattgaatgacaaagacattgagtgatgtctttaatctccgaatatgtaaaaacaattttaattgaaactaatttctgatgcctttacatattcggagattaaattgtgagcacgcaacctttttaagggtcttatcaatacaagttgtcacttttgtaaaagaaaaaaaaattgtatatttactccaacaagatcaaatgtgcacttagagcaacactctattgcttcgtttatttttggatggtttgggtgagagatttgtgtgtgtgggcaggggtgagtgaaagagggaagaactaggagttgcatgtgtttgcttgtataaaagtgacaagtaaatggtgatggatctcacagaaaatgctcccctctccataaatgagactgcacattatagaagttaggaattagcaagctatcgaaaatatctttatttttttcttcttatttcatattatttaggaaaatttttagtaaatttatctttcaataaacattatgttttcttttttttcctacccttcttctcttgtctggatcacatgagtggataaaatttttactgtatcttttcattcttatatctctatctaaataatacatatttttatctcatctatcttctttccctccctcctctatcatctatttcgttcttatttcttttttatccaaacacataataaaggaaggtatttaagactctaaatataaactttgaaaaaaaaattagagagatttttgagttgcaatggtgttcaggggactagtttcatataatttgtgggaatatcttagtttcttctttttttttccttgatgtacatcaagggtaggataatactactaaattaataaccaagatgaaatgtcaattttaatcaaagaacaacattaataatatctataatagtacatctaaagtgtatccttaattaatagtgataaaaaaggtatgaagatattacttgtaacataatttacagtccaaatcccaaatggaccaaatcaataaataattttcacgaggccaaaatcgaatttgtgattcctcaatgatttttttttaaaaagcgaagtaacgaagtaaatgaattaggaaccagtaattgaaaaagtcaaaacaagaagatactaacatccatataaacaggccaaacactattgttttgtattttttactaaactgacataatcacacacgaactatgattggttgaaaagcaaatatgaaacttcattgttttttagcgtgcaaatttagatgctgaccaagaaaaacaaaggctcccttcgctagcgaattaagatcacacatttgaaccattggctttcagactttgacagtatctgaatgatctaattgttatgttcaaatactgtaattttagctccacttcctaaaacacttgccagtcgttccaactcaaattaccatcctcaaatacacataaaatttaaattcatatttgtccaactagtagcaaagaaaacaattggaagggaactccacaaacagaattccaaacgaattccaatataatcaatagaagttgtccatactagaataagagaaatggtgaaatatagataactatggttatcattccatgagaaaacagcagaaaccataacatgagaaaattataaacattaattcataaaaatattaacaataagcaagtacaaagtccaattcactgatagtagattgcttagtatgctcatccgtttctagcaccaagcacatgcacctgaattgttcttatttttcgatcttctcctgatataatttcacagatgcatgcatcatttttatttatcttgttctttttacaaaaacttgtccaccctttgatgcatactcgaccatcatgccactcagacacttttgctaattcagaatatatgggtgtccattgtggcaagccatgatagtctcgtaattcatctctttgagtatcctgtagcaacaaaaaaggcacagaactgtaatttcaaattctcaattagacaacccaattaattaatacatacaaatgtacctgacatatagttgacaaaatggtaagtaacttctaaaattatacctcgctttggaagcattggcaacgtgaaagggtaatctgttctccaaaagtaagggacgagtccttaatcacattttttggaacatgctgaaataaggaggaatgaagtgaaaagtaagaacatgtaatagttgagttatgaaaagtgaaattgcaataacgaggcttaaagagtgacagaaaatgaagaatcactcaattaacatcttaatttcaacatggacataattatatagaaagattaaacgtgtttacagtccaaaggaatttaacttcaaggagggaacaaaggcttaagcaaatttagttactcgtctaacacagtgctccagggacaatatatataaagattctaaccaattcgttgggtctatttttgaagagctttgcttcaaaatttggatttcccggctgaatatacatttgtggatcaaattcatagttttcaagatgaggaccttcaaccacaggactggaacttgttgcacttaaccctaaaccagataaatcaatcatcaggtaaaagctgattcgcgcactcataaaatacagaaattggaccaaaaaaacaaaaacaaaacccagtttttatcacaaagttaacttttggaagctctacgaggatgagtttgactcctcgtgtattcagcactatgttcttcttcactctcttcttccatttctctatactgatcaccatcatcctcatcatcctcagcttcttcatgttcttcatcatctgtaatctctatcacctcatcctcttcttcagcttctgtcctttcacaccgtgatgattgttcaagaattacaaccttgaaaatgttggccccatcatacttaaaaacaatataatcttcttttcctaaaaagttttcttcttgaaaaatcttccaaccctcttcaaagtaaattttgtttccaacaagacgtgttttcacattccaaactctcccaccaacatttgtgaggatgacatcctcagggatcctccatccttgtaagcgtgtagatttcacaaaagcatctgggataagctgaaatttatagaaaagcagaaatgttacttaagatctcgtaaaaaaaatgtggtatatatggcacacacattatgttatcaatataattatatgtaatgatctatatcttgtattacaatattccaagtagaaatttgaggacattaatgttatatcttcgtgcaagtctaggtttgaagtatattaaacaaaataccatgctttcggagtgttcctccggtttgaagactgtgacgaagtactttttggcagccatccaaagaaatttacacctctcttgtgatattccaacaaatgaaatttggtcaagaaattgaaatgccagaacacacagatttatgacatatatatatatatatatatatagcctgaggggtacctagcaaatagtacttccgtataagcactctagtgagtaaggataataatgcattgactgcatgagaacattctattaatatttatttatttttactgtttttaaaatttttgtccatacgaaagaatgctgatccaataaaaataattaataacctattatcatggataaatattaaagcaatttaattatttattcatttttaaattattacaaaaagtaaagaaaaaagagagccaccaatatgattagatccacatgtcaatcaatgacaaagaatcaaagagaaagaaaagaaaaaaagatgataagagttttaaatgatcttattaataaatgtaattaactcagataactctttaaagtcttctctcacttttgtctctcattttttttcctgttttttctctctcacatggaaccgtctaaaagcccatatctaaagacctgatgaaaaatgtctacactttaaagcctaaaaccaactcaaataattagttgccttcctctaaaaagctcaattaataaccaaaatatcacattctatgattctaccgtgtgttcagtactgttcctttgtctttacttggagataatctttgtggtccttcgcaggtgatgttattacaaaatatgctatttcagaaaagcttaaacaaaagcaactttcagttgctatttttataaataacctacgaactaggttgcttaattaggtctggtaataaaatttcagtttcaagataacactgaaatttgcagcttgcgggctttaaagtatacgatttgattctatagccgtatcaagcatttataagaggttgtttggttggagaaaaaagaaaagaagagaagaagaaaaaagaaaaaaatatttaaattaaaataatatatatatatatatatatatatatatatgagactcacaaaaaatttaatttttttctttccttattatttaatctcaaaaaacaacctctaaatgtcttcccctttaatattatgtgtcaacctcgagaataacaactcacccctggcatgttttctacaggattgcatttttgtactaaaagtctaaaagtcatcatatatataaacataacttattatacaaaacagacataataacctactcaaagataaataataaaagaacactggccaatttttttaataaaagaatgcttttaggtcttaagaattaatgttataataattattataaaagccatacataccataatttttgtattgattaacagtgtactttttttcactcttacaatatatgaaaattaaattcattgacatataatattttgtaaaaattcttcattttaaaaatatttttaaattccaataaatttaccttttatcattttaaatttttaatatctgcatttttttgagaaaaataatgtatacataaattaatgaaattaaataaacatgatttatacgagtagtcaaattaaaaatattttcaaattagcctatttaagaaatgtgttgataaaattagctaacttgtaagcttggtcagcttgggctaattttctttagatgtttaatgggacaaaatttaagacgccttgtaatatagtaactttttccattaatttttgtagcatgtaataaggaatataagtttgctggttaagagctgcatatgttattgggaaatgggagctataagatggttaaaaagtatgttgtcgaagaaaacgatgattaacaactaacaagtacataggaagacaataatctgttgaattcgggaaaagtttatatacatttttttaatcttctagttcgttagaaaaaagacattttaactaatgcagagttcgataaaaaaaaaaaatggtctataatccattataaggtgcactgagttatggaaagagaaaatagaaaggtaaaaaataaaaggtaataatgtaataattgatgcaatagaaaaaataaaaaataaataaaaaagtgaaaaataggccagagttggtgtatgtatgcagagttggtgattgccttgtttttctttgggtttcaagaccttgaccatttaattctgagaattgaaaagattgtcatcagcctgagagttgagttgataaagtggcaatacagaaaaaggaaaaacattaaagtgcggtaaaattacctttctattttccattttaagaggacaatcgcttcctacacccccattctggaatgtaatttatattcccggttagtcatttatgaatgtaaaaaatttacattctagaaagtctaatccgaaatttttagattagacttttcaaaagattaaaaagatgcagaaaataatcatggtggtgcaagaagtaattaccagacaagaaagtccattgtaggcttgtaggccattcttcaaagggatttgaattttgcactcacatatatgtatcctactcctttcatttttatttgaaaataccaaactacccttcctccttgtgcgaactactcctgtgatgacacctctttcaatcgcgattacaacttcttctcccatgacttcaccttcttcagggcaacttccgacctcctcctcacaagtcatgatgttgaagaacctcctcccccctcctccttcctttgcgcgtcgccattgaaggtaagaatgtaatccaaaacatgatgtttttgtcacgacaaatttgaaatgttttttatttttaaccattatttcggagacatgattctgaaagcagccttatggaatatgaccgttccgaaacatagattgagttccggaatacataaaatgttttttttttgttttcaaccattattttttactgttatagaatagacattccagaagctatttctcactattatggaacacctattcgaaaggagaaagttattttttactgttatgaaacacgtattttggaaactattttttattgttatggaacacctattctggaaggcggaaattattttttaatgttatagaacacctattttggaagctattttttatgttatggaacaactattctgaaagccaacagctatttttatattgttatgaaacaactattctggaagctatttattattgttatgaaactcctattctgaaagacgaaagttattttttactgttatagaacacctattctaaaagacaaaactatattttactattatggaatatttatttcgaaaaataaaactattttttactattatgtaacacctattttgaaaaggtataatatgaaaatgataatttaaaattttaaaaaaattggaaggtacatgatttagtatgaaaggtgcatgattcaaatcccttcatcaaagcctatagtttggtaactaagctgctagcctattaccatcacaacatgccacaatacacagttaaggcctaaaggaagcatcttttttttttatatatatattttccttatattttaaatttattataattttttaactcagtaaactctctaaatgcttcagtcacttttgtctcattttttttcctgtcttttctctctcaaatggaagtctaatatacaaaagaaaacacccactaaagcccaaacctaaagacccaagatcaacaatatctacactttaaagcctaaaacaaactcaaattagttttctcccttcaaaaaaagctgaattgcaaaggagaaaggtccacacaaatatcaaattctacaatgtaaatgttcctttgcctgtactaggaaatcatctttgtggtcccttatactagtaatgttattacaaaatatgctatttcaaaaaagtttaaacaacaagtaactctgaatagtttttttttttttttttcaacaaagagaaacaaatttatatgaaaatgagtataagggatatccaaacccttttacgaaataaatagctaagtaactaccctccaatatcctccttcctaatagtggttattttgtatttacatatgtccttggaaataaaaataaaataaccacagtaaaaggattgttattcatcctacaagaaaccagcaaacttatacgatttgattctatagcggtttcaagcattataaatgtcttccgcttaatatcatgtgtcaactgcaacaataacaacttcacccctcacccgtggcatgttttctacacgggattgcattttttgtattaaaagtcatatatataaacttaactgataaaaaaactattatacaaacatgtttaaatatttgtaaatgatataatacatttatgattatgaatataaagctattttaatatattttaatattcacaattatttttacacataatatattaaaaataaaaaataaattataattataataatataaaaacttacatactataaattaacattcgtgcataatataacgtgagttattacactagttagaataaaatttatttggtttctaataaacaatcaatgataataagagtacaacttatatcatatgataataggttttacataaatttcaccttataaaaaaaacattcgttcatgaggtatgataaaactagactaagcttctgaagtgagaatgtatataaaaaaataaaaaataaaagtaattgcacattgttgagtatgtggagcccaatagaaagaattataaagacccaaacatcatacaatatgttttgttttctgttttattaatatataaaacatttgtacggaaaaaaaattggatgacttttcactttcttctctctctctctctctcgaagtttttatgtctttctcttttcgtcttcttcactcattcccgatgtgacctagctctgctagggtttattgctttcgattaatatcttgagctctgcctgttgagcaatgtagatgatagtagtgtaggtctttgttcttgttcttgtttatcttacattgcaggtgaaggttctctcatgtctggttcaaggaatcggaggagaggaactcaatgaaggttaaatgttgtctggcccaaacaatggtgtaaagggttatttctggttccctataaaccttcattttctttctataatcttgagacctatgttcattggttgagtaacttgtcgtgtaactttgagttgaacactattgtaactcttcttgggatttagtgcaagtaaagggactacagctcccttgcccccttcgatgtaggtaataaggatttttcttcctagttactaaaccaagtaaatgctcgtatttcttttctttcattatgtttccgctaatttcattttaagattgtgcacctaatctctaagacacataaatctatttcaaatcaagaacgaatacacaatgcatcaacaccatgtgatacgaaaggtaaatatagaaactgcccctcaatgcttctaggttttatttgtcttttaaggcatatttataggttttatgtcttaaaagacttcataatagttaagcatctaattttattttgtcttagattaaagattatgtatctttcctaactagtagttaaaaactaattttgctcgtgatacatgactattgttggtccaataaaagtttacatacaggaagaatcaaatacaattcttttactaattagatcatcgttttcttatatgttaacacatcaagaccttatatatcattatggcaattcttagttattatgcgtttgattgagtgtacatgatcaaaaatactaagtaccgaaaataaaggatttaggaaccagtaaatggaaaagtcaaaataagaagctattaacatttattaacaaacccaacactattacttgcattgtattcttctagaaaagaattacttgcatagtattaccaaactaacataatcacaaacaaactaaggttggttgaaaaacaaatattaaacttatcgtttatttggtgtgcaaatttagatactggccaataaaactgaaggctcccttttgctagctaattaagttcaccgtttgaactattggctttcaaactttggcaatatttgaatgaccaaattgttattatgttcaaatactgtaattatagttccactttctgaaacacttgcaactcgttccaacatcaaattggttcaccaaactcatgcgcataaaactttaaatttgtatttgtccaattagcagcaaagcaaacaagtggaatttaaccccatcctcgttgagcatgcaaaggtaagtttagctgtggttttttttttttttttttacgaaagtttaacttcatgttaaaaaatggtttttgattttccaaattctgtatttatgagtgctgaatcaggctttgtcagatgatttatttatctgccttgggggagaatgcaacaagttccacttccacccatgattgaaggtagtcttgaagagactagaaatttgatccacaaatatattcagcaaggaaaatccatattttgaagcaaaactcataaaaaatagacccaacgaattggttagaatcataatttttctagttctatctcttctaatttgctgagaagagacataaagattctaaccaatttgttggatatattttttaggagctttgatttaaaatatggatttacctaaatatacatttgtgatcaaattcatagtcttcaagacgaagaccttcaatcatgagtgaaaggaacttgttgcattctcccataaaccagataaataaatcatcaggcaaaggctgattcagcactcataaatacataaatttgaaaatcaaaaaccagttttcacataaagttaaactttgataaaaaaaaaaataacataaagttaaacttacttttgcaagctctccgatgatgagtttgactactcgtgtattcagcactattttcttcttaactctcttcttccatgtctctatactcatgatcatgatcctcattctcatcctcatcctcatcctcgtcctcgtcctcagttgcttcatgttcttcctcatcttcagcttctctcctttcacacagtcatcattgttcaagaattacaaccttgaacacattgatcccatcatgcttaaaaagtagaaaatctgtttttcctgaacagttttctttttgaaaaacctgccaaccctcttcaaagtaaattctgttccaacaagaagtgttttgacattccaaatactcccactaacttttccgaggatggtgtgtagacttcacaaaagcatttcggataagctgcaatttgagaaaaagcagaagatgagtgttacttaagacactataatactctggtaatgttttgaaatcaacaaatacattggtataaagcaatgtaggctacatagttaaatctcagtaaatttatgatccatacaatgtaccacaaaattttaagttgaaatctgaggacatcaatgctaaatcttcatataagcctacactgcagaaagtataataataaaaaaaaaataccttgctcatttaatccaatgaaaattgaaaaaaaaaattgtcaccaacctgagagttgataataagtggccaataccagaaaatactaaaaggaaaaacactataaggtgccaacatgaaagtccattgcaggcctgtagcccagagtttagtccattaacatcacaacatgccacaatacacagttaaggcccaaagggaaattaacatcattatgatccttatagcttattgaacaattctattatattgttgttgttataaaagacttttttttaatgaatactcaatcacagatcgggataagaaaaaaattaagtatcggaattaagaaacgttccttcattaattctcattttatgtgtcacttttaaaatatttctgtattaattgtcattttaaaacataaaaaagtatcaagtacgtttttcaatatatttttgggataaatgtattttgattaaataagattttaacatgtgagaatagatcacatcaagttttaacatgtgagatcccattttcatctgttattagatttaaccaacaagcatctaattccttccacttctcccttctgcaatctatacctcgtaattttaatggcaccagcaaaaattctcacttaacagaaccagacaaaaaacaaatccacatatacatccatcattttcttttattttgtctcttttatttatacaaaagcatgcccactatttaatacatcatcaccatcttcccacttgcacactctcctgttacttaacaatttttttttttcatgtctcttgaagaaggaacatgtaatagttgttagtaatgaaaagtgaaattgcaacaatgaggcttaaagagggacagaaaatgaagaccactgaattaacattttcaacgtacatgaacataattatatacagaaaataaaatttaaaagagcttgccactttgacattcctaagtgttttttgcatgtgtgttgtggcaagcagagaagaaagtctcatcattgatatagcaattaatagggaggaatgaagccataagtgaaaagtagagtagatggaaggaggaatatgtgcagtgtacttggtgttggtgtgagttatgaaaagtgcaattgaaacagcgaggtgttaccacttaccaggcactgtttttttcttctgcagttgcttttctcttctatattccgctctttctctaactttaccacaattcttccatacatgttgataattgaaaggtgatgatttttaagtcattctctccttatactgaaaaattaaacagtcttttctatatgctgttttaaaaaaatgattttctagtttttatatatgatgaaagaataagttcaaaataataatccttcagccatcaacagtgtatgaaaagaatgtgataaagttgcagaggaggaaaatatagaacagaaagcaggtatagaagaagaggagattgagatagcaaaggaagaggaagacactgaagatgaggaaatatgatgatcactgattctgaagacaacaacgatgagtatccatgatctaatatatatagcgtgagggttatttaattttgttggttttaattataacagagaataaataacatagatagagagtgtgatggaaaagaataagaaaatataacttattattaagattttgtcttttaactaaggtattatccataacaaattgaacaacttcctaaaatcaagcaaaatagactccagacttatttaaaataaaataaatggataatttaaaagtaactgctaacaaatttgtttatttttgtctataaaagaaaaaaaaaacagaatttacaacaactcaattcctatgttggtcaacaaccagcgttagactcgtttgacatgagctatctaattagagatctaatatatatacacatttaatatacttgtataattaaatgagtaagggctgtgcattttatttttacagtttacatctctaattaaatcagtaatgaccctgcattttgtttttactgttttaatttttatccatatgaaagaatgttgatccaataaaaaaaattaagaacatattgacaccgaaaaatattaaaggaagttaattgtttttccatttttaaattaatatcatgaaataaataagggaaaaaaggagtcatcattccaccaatatgattggattcgcatgtcaaattgtcaatgaaggacaaagatagaaaagaagaaaaaaaaagatatatttctaattctagatgatcctttcaatatctaacgataggatttttttatgcaatatattagcagtgtaatctttgaagtttcattttttgtcttaaattttcaaaccacatttaactactcattttaaaacaaaacttattttttattattttcttgtattttaaaattataattctcactcttttaacaattttaattcttctcttacttttaacagtcttttttctctcacttccaagactaatgtagacgaaaacactcctctaaagtctaaaaccaaaacataaatgcccgataaaaataaaaataaaaaattaaacatctttgcgagtttatgacataagaagatggttcatatgcattgtgcagtgcactaatagtttcagatgaaggcgttattatcacctgataaccatgatagctagttagttgactataacagctacttagtttagttaactttgcttatctggcaatacttatctgaatacttttgtatatgagacacaatacaatatctacatagccatgtatgaattgaatcattctttctataagaaaataatgagaactccattttctctcggtttctatcaccgacagttaatatgcaaatgctgccttcaatttttatttgtggtccctcactaatttctgaaaatgtttaatcaccccaagcaactttcagcacctagcttttctatttttatgaataatctatggcctatagtatatatgactgtgactatgaaccaggttgcctaagttaggtctgatgaaataattgcaatttcatgatgacaccgaaaacttcttcaacaggcttgtatggttagattcccatccgtattaagtattaattaatggacaatggcttatactttataagagagaaaatagataacagccatagtcattaacatagtcatcataaaatttaacgtaacagtacttactctagcaatacttttagtattgaaataatttttgtgtcaagttcttaaatttacatgtcattctcagccctcacaaatttaaaataaataatctatttaaacaattatacattataaatgtcctatataagtgtttacaaatattgataccaattttattttgtcaataatgtgcatgtttgattaaacatttgaatctctaagaatatgtttacccacaaatccaaaggatatttgtctccattcgtttgttagatgtctatgggaatgcatgtcactgcatcttcatcagaaatccaaacataaacaatatatgtgatttatttttttgttgaaaataataatatctgtaattaatatattgatattccctccatttctttcaattgtcaccttaaaaagttaatacaaagattaaaaaagtaattaatatttttttttgtaaaattattttaactttagaatataattttactattattttctctcatttatcataaatgtatatagtatttaagacctaaatgaatagaaggacataattaaaaaatggattgataaaaataatcaataggattatcaattatcaagtataaatcatttaattatgtttttgatccctaataaatatttaattttttatttgtttcttaataaatttgtgttttgcattgaatttctaataaaacaacaattttgtttacgatcttttacacttatttctagtccatgataaaatagtggattttatgtttattcttttataattttattcatttattattagtcaaatttaaaataaaattcactaatttattggagagcaaacaaaaaactcgttaatttatcatagacaaataaaaatatcaataacaaaaaataaaagtgttattttattagaaactaaacttaaaacaaaaatttattagaaaacaaacacaaaaaccaaatatttatcagagataaaaaaaatatttaagcaaacattaatatatactaaataattaattaatgggaagcacttaaaaacaatattagagacactattagtataattttccagtcaaaatcagcaatttaccatgacaatcactcctttcatttcctttacaatcggtagtaactattaaaatgatgtgccaattttgatcagagaacaaggttaataatctccaaaataacttatttaatttttgtccttaactaatattgataaagaaaaaggtgatctcagtaatgaagacgttacttgaaacatgatttactgtccaattgcaaaatcaacaaataattttcaaaaggcaagtaccggattttgtcttgcgccttttgaatttaattatatttcaatatctccctaccttgctatggacatgggtggagaacttttgtggaggaacttaattgatatgcgcaaagtacgttattgccttgttttcttttggtttcaagacctggtaatttactcattgaaaattgaaacatactttttctttcccaccaaaatcgaaacttgaaacatactcttttttttcaccaaaatttgaaacaaatatagaaatttcaagacctgagggttgatatggtcagagacagaaagacgtggcttgaaacattaaagtctaattgtaggcttgaagcctattcttcaaagcctagtcggagatgcatttgaccaggaaataccgtactagccatcaccttcacaagtcacaacattttctttctcacaacattctgtatctctgtgtgcatcaaatgcatccaatagctctaagaacaaatattattgctgttacaaaaacattttcatgaattttcaatcatagatctagttgaataaatttaagtaaaggatctagttgaataaaatctgctactcaattattctgcacttgaaaggcttcataataattacttaattaggggtatgatttcgtgtacaaaaaaagaaaagacgaagtaataaagaaaaagaaactaggaaccaataatctaataagtcacaaacactcttacttcgtagactctattaccaaactgataatcacaaactaagattatgcaatatgcttctttattgtgaaggaagtcgaccgataaaatgatttctgagtagctgcaacttgaaaaacctcaaaactttctgcatcatatacgttaactatcttatcttatctgaccataagcacccaaaaaaatctgcagctcttaatcagttaacttatattccttattacatgttacaaaaaattaatgaaaaaagttatatactccaactccaagccacgggtccctctactaatttcaacataaaaaattacactaaaaacacttaaattttgtcccattaaacatctaaagaaatctatcccaagctgagtgaccaacccctgaatacacgcaattagtcaacataaagctgttacactcattaaaaaaaaaaccaaatattctttaacttgatagataataaataaattatacaagaaaacaactcaatacatctgaaaaattccaatccaaaaaattccagaatttcttcctacaaccaacaatctcatctttctggccaaaattcaccaatattacattgaacatcatagaaggcttccagaaacttgaatatgctgaactttttcaatttatgtatactacatttcaaacaaaatagagtacatttcagtttaattgaaaatccagtctcattctctgaatctctagtccaattccaactattaaaacgtaccattacgacaatggaataaaaaatgcacatacaaatctaccgaaaatgacgaacaatttcagaagtaaaatcaatgactaagctgctgccttacttgaggtttaatagcaaataatatcttggcgtaaaacaaaaagtagtaacagaactaaaccccaagcaattcgctttggatctaaaaagacaaagaaaatcgcaacaatttcaattcaacatattacaactaaaaaggccgaaccaacctgagaagaatccaccgaacagaccggccgtccagatcctgccgtttacacgcgcgcgactgccggcgcggcggaagaagcggcggcgccgccgaggaacgagaggaatccggagctgttaggctcctgatcgtcgagaaacagatcctcgggaacgcggaacgcgccgtgcgcgcacacgatcgccaatccaaccatgagtgcagagatcaacaaggatccaacgctggtgaggaaaatgacgaacacggtgagcacaacgaggatccctagggtttcgcgatcggcgaaggtgcgtccgaagaggatgagaggctgatccgaagggcgaaagagataaaggaatgaccacgacgcgaggagaccgaagaggacgagtagcgagaacggatgcgtgatgagcgagaccacgagcgcaaacgcgattagggttaggtaattgacgcggaagtaggcaaagttcttgcggatccgagagtatgcttcggcgagggtgtcaggtcgggacatggagctccgttcgatgagctccgtccacgggcgacgctgcgcgaaggcgtggcggagcgacgaggagatgcgggagatgaaggcgcggaacgccggcgtcgcgatcggaggctgggactgcgaggtgccgccgccggaagcgctggattgggaggatatagggagtgtcggtggagaggccatggtggcgcgtgaatctccaattgccgcgcgtgaaccaatagagagagcgaggggcaatggagactctgtggttgggcctttcgggtttgggaacgaggaagagcgcgaggggggtgttagtatgtaaatgtaaatgtccgaaaataaccttcctaatgtgagatgggcatgcgtcgaacctatttgcagaaaacgcaacgcaaaatatacgtaataatgtgaaaaaaaataagtttttaaaaaataagaaccaaaataacgtcaatatgtgtaataaggatcataattgaaatttgaaaagaagcaatcagtttttattttaatttaattaaaatacacatagtatttttttattatcatctaatcataaaaaataattaaataaatattatttttataataattaattaaaagtcatgacaagtataaatattaactattttttttttcttacaagtcataattaacacataatattgaaaaatataagttactattagtatagttttataatattatattatttatttagtactagggaaattatgtgcacttttaatccttcatttattaatataatatatattaatccctcgtacattaatgttatatacaatgtatttttatacaatcaaatgaacaagtaaaaatttgacaaagtaattttcacgttaaagtagattaaataaaaataattacggtttcctatataaatctttcggaaaaaaaatgcaaaataagatcatattttgaatttaaaagaaaaaaaaattcttaaactaatgaactccttaacgttctgtttttgtttgtatgtcaccttggtcttttttatataaaaaatatcaatatttaacagctgtatctatctggctagacgtttgatacttttggtgggcaattgctttctacacctctcttttttttacttcttgtacctccaaaaatgtccaaacaaacaacaatacctcctccacccaacaccaccgtgccccacttccacccaacaaccatccaacaccactgttgatgactctgactctggtgctggtgtggggaaaaagtcatgcatggagtcgaggacacgagagaagtggaagtaaaacgtgataacattttgaaaatgttttttctgaaattatgaattttttttaaccttttttctgaaattagcataataatttaaacttttcataattatgctaacaaaatatcgaaaatacatttccaaaatgttattttattttttacataatttcataccaaatacccatgaggctgtaagcccatgaccattttacacacaactcaacaatgtgttgagtagtttgagagattttatataactattgatgaggtgataatttgaataacccttaaaatttaaaattctcaaaattagttaaaatttgagaaaaacttgtggtttgaccattacatcgagtcttttttaagaggaattacatcaagtcttagggggcgtttacttgtagtttttattttctgattccattttttatttttacttcttaattataaatttttaatttttttcttatttttaaatatttatacagaaaacattttttttctctgttcaaatctttaaaacacagaaaatagattaaaaataagataacaattttgcaattaagaaataaaagtacaagtaaacgccccagtttttctcacatttttttgtatttctataaatatataatttttctgttaaaattatactttttcacatgttatatttgaggattaaattactttcattgttttaaaagcgcttttaaaaaaatgtttaaagaaaaactaatctaaacccattcaatatcctttaattgaaaacaaaataatacatgcccgcatttattaaagtcaacatgtcaatgtgcctagatcatgaccaggtatcgtaacaaagtagtacattgtgtatacaacaattattacaccttcctttcctacaagagttttaaatatttctaaagtgggaatatattcacgtattaggtttactaccgatatgaatatgttgaaactaggtgtggattaggtagcaaccatccaagcagaagtggaagcatttattatgttactttcttgccttcaagagaaacatacttaagtcaacaatatatgctgagcatctgaactttctaacctagcttgcctcatttttttattgaaagtgcctaggccagttatgtcagaggtggaagaattaatgcaacttattttgtgtgtaacctttttacataattatttaatgttagtatgttacagacataattgtgtataaccttttgcaattacaacatttgtagggactatggatttattaaaatatttttctaccaccttgtctcaagtaacgggcatatgtcatgttagcacattagatgctctttaagaaataagtcaaccatatgtaaaaaaaaaaaaaaaaaaattatcacgatcgtggtatttgtttgacacattgaattattagacatgaaattaaataagtgtttagactttaaaaagtcttgcaaaatttgaattgcaatattcaatacttaattttataaaattataatacaattgaatacaaggtgccttaatgataacaacaaaaaatttgagaagggataattcttctatagagtgggagtaagggtttcttagtatattagataactgccagacaggggaattatgatgttgttccatagttaaagaagcacactagagatgacttctcgcaactcgagaattttaacaagcatgattactgtcactagccgcttccatcattattttactattactagtgtcatttttgtcatttttatttttcttcacagtgttcgtggtttggattgaatcggttttgaaataaaaaattattttatttaattcttttggtttgatcatttgattattcattcgatttaaatttttttttaaatccgatccaatccaatccaattttttttgatttggattggatcaatttttaattttttaaaaagtctaaaaataaaatttatgagacttattttttattaaaataaggagtatctagcatacacaaacacattcattggacaaaaacaaataccattttttaattttcattggacaaacacgatcattggacaaaataaggagcaatatattgagtttttgatttttggaatatgatgaggaataaacccaaataggtaaagggtaaagtaaggtttataattggattgatttggattggatcgattttcaccagtcaaaccgaaaatcgatccaatccaataaaaattttcaattttttttcaattttcaattatttcaattatcaatttttcgattcgatcaccataatccctactcacaattaccatcactaatgcttctactacaattattgttgtcgccacactaacttaactattgcaactaccattgatcgttgatcatgttgcaaccattatctccttcatactactactgttgttagactattacttatggattaatttcttttcactcaattttgatttgaccccatttatattgctacgcttaagtaaaaatgtccaaatgaaattaaaatttacaattgtacacactagttttctatacaacgtaaacagaagagttatgcttttaaataattctatgtgctttttttctttttacagcaactaattaattctatgtgttaaacataccctcaacattatcgtaatcaaatgaatgataaaaagaaaaagttgatcaaattggtcaataaaaagagtaagaaaatacttaatacaagcatgcatcggggcatataccgttcgtaatcatgaaaaattgataactcataaaggtccaatcttatccatgttcctttcctttgagctgaattgcgtatccgagtgtgataacatttgatgttatattccaaactgtcagacctactattttcatatattcccttatcaaacagaacatagctttcagcatttcccccatcgaaaaaccgctataagcacatggtttgagataatttactatagaccgttccttacttccaaatcttttccttctctagtaaaatgttttgtctaggcattagactctaattaagttacattatagttttccttccacattatatagtaatattaatgtataacacccaactcaaatctaaacacaattttatataggcttaaatttttatgttccctttatataggctttaaatttaattttattattcaaaaacgacatcatgcgataactttaatcgttattaaataacttttagtgagaatttaaaatcacatcatttttgttaaaaatatagtttaaaaacaaataaaatttaacagaaattaaattaaaaatgatcatattttattgctgaatagttagttaacatattaatttactgaattcaggataaactaatgatcaatagattatatatcaattatataaaaaagatagtggcagctgcatgcagttcctcgtctcaacaaataacaagtcgcatataatttttataacacagtgtccttctcatgcaattaatcattttaataaatatagaatttgaatctttgaaattgttattattttatatattaacagttaaatttaatttactttgaattctagaagccacattatgcttgtggagaaatcctaagtactagttaggtggcgtaaacacactaggcttatctcaatcaatattcacaaatattcaagaaagctaattaagcaaaaaaaaattttagttatattagttagtttgacgtgaagcgtgaagcacacccttcgtaaatttgtttatgtcagttaaaatcagtatttatttttaatgtaaggttttatgttaaaaaggcaaggatgcgtgagatgtttcatttttttttttttaaattatcacgaataatcaatctttctcccttgttagggtcatccctccactctatggccattattaacatgcacaaagggaaaatgttaacaaagtgagcaacttgcgcattaatttgaactattagtgacaaacatacattgcacacgaatctgaatttcaactaaaatgaaatatcctaataaaagactacctatattcgtcgttaaagcactatctattagctaagattttcacgcatgtgggtagagaatcgaatgccctttttacaaacaaaagatgtcgttgcccgtggaagttccactcgtcaaataataaatgtttgtaaatatatgattggccttccttatttttttttatttttttgttttaattttctgaaagagaaatttcatatcatccacaattgagaacgaatatttccattactgagacataactttgtgttatttgccaatcggattcaaaggctagaccttgtcaagccacataagtaccgtagatatgctactctagtatttaatatggacaatcaaggatttctcaggaaggaattggcatcttcaatttatccatgtcgtcagagaaggaaatcagtgtataaatttgactatattaaaagaacacaccttaacaattatacttgcaaaacttgttaaaaataataataatatattatacataaatgtaaacaacttttataaatgtatcatgtgggatcggatcatatttcaatctttacatgtttagttcctaggcatcttttgcttaaggctaggtagctgtgtactccttgtatccgattgtatttctacacacttagtctctatgcatctcatgtttgaggttaagagactctatatcctcctagatcaatttgtgtccccattcacaatcctccttaaagggttttagcccgacactatctcattatatcatatcatgtccaattcaatcacctctaagagtaattacaccataaaatatcatggacacaattatgtacaaaaatcctctagatatcatgaacattctgatatattataatttctcaacccataaatattcgaaaaatatgcgtaacacaagcataaataatcatctctttgatctaagaagacaggttaaataagacactttatttaagtgttttggactaggtcttcttatactaagaatcttttgttgaaataataaatttattatttttttcaatttttttcttaattccataacgaataaaaactaatagagactttacgtacgtaacccatatagttctgaaatcatctatatcaaagaacaaacatatacggaacactttttgttaaaccgattttttaaacaactattattcgtaaattaagagtatatatgatttgaaagagtagctttattcctcacggaccccttgatcatgaaaatggtagcttaattgatattgatatatagcttaaaagttgtatatatgttttgtaaaaatattactcaatattaattagtttgtacaagatatatacttttggtctttgtcatgtacaccccaccttcacccgataaagtgaggcagtagtgtttataaaacgagttgaaacttgaaacaagtttaacacgatcgtatatactcaaaattttgatattttattttatatttaattttaaacttaaattgacataataagaaatgataatatatgagataaaattgagtcaacttaattcattaacataatatataaattttaacattatttattactaaatcataaattaaaaaatataaaactaaattaaagtataatgtatggtatatatttcaaaataaataatattaaaatatattatcattttattaactattttcagaaatcttattattaatacataattattttgaaaaacatgcatatacattttaaaagaatatgaaacactaaattggtttgagatatatattgtttttagataaattgaaattaatataatttaaactttatttcagaatatgttataagtataatttctaaatcttaaatttgtaaaaattaacttaaagtcggacgaggttagttagtgaagtggaacatatatgcctatccaaataagtaaaataataatcgttcttttgtttttattattgcattttgtaatcatgctagaataaccatgcatttttagacaactaacacatgtgatgggaacgatagaacacacaaataatcagtttatcttgtaagtacacactatccatcattgcttttcccaggtgctaatcgttgtactaatcacatgcacaactacttttgacttttcttgcccaacaagaatctttactaatttgctttttcatccgttaaatagagaactcaccaaatatattaagtcccacacgacaacacccatagagttatagctagctaggttaactttctgccatggcttattacagatttcttgatgtgttttcatggattcaaaaccttccaccaatcccagaatggaaaacagcttccatgtccctgagcatatgttccacaaactcatctcagccatcacttaatctcaccatagcaaaaaatcatcaccaatccccaagaatctctttagccattgtggcagacttcaacattcccatctccctttggacctctaaacctttcaaacccagcaccaaaaccatgaggttaacagatgatgaaaccctttccaatctccttgttaatttcatagaagagatccttcattatggctccaacaagcacagtattccctatatcaagttccccaaacttgattctgtttccaacttccaagacattttcaaccttgcttttctcaccctcttgttcctagtttgcatatatgaagccccttctgatcttcgttctggttgccttagcactttgaaagaacaattggcagggtgtcaatcaaggcaagcatcaaaatttctgatgaaactcttgggttccaacttggaagagcagtggatgcgttctgtgaaccttgcaatcacaaattggattgtggagatccaagaagcacatcacagtactgatcacactaccttcagaacaccatctcctctattttcttatgcgttctcaacgtctgggttgtggaaagttcaattgtactgccctgtcataaacatggatgttgtcaatgcaaacaaccacccagctgatgagaggcttcaattctctctcaagtaccagcagcttgaaggtgttcttcaattcaattacaaagtcataattagagagaggtgggttgaaatcggggtgaacattgacaacataaggtaatcaaataatatttatcaaattcaaaaaaaaaaaaatttattttttgttagttaacctcacaatttaataaattaatattatattttttctaatttaattttgtatcttagaagacacgaaaaattattatataatttgagactatcatgattttgaatttttgacaaatctctatatataccacaaagttaaggattgttaattctttcttataaactaattttgttagttatatgttgtataaagattagttggaattatgagcgtacatgttgattaatttgaatctatctaataattctttaatatcaccggtatctttatgtgtcaactttttttcgcatccttccaattgaaaaatgattcttccaaaaaaaaaaaaaattaacaaatctgagaaaaataaaattttccaatcgcatgcatgacattttttctattgaaaagacagaaaaaggagataaaaaattgaaggtgatcatatctatgtatctcaagttcaacacaataaaatcaacaaattcgtgagaaaacgttattttccaatcacgtgtcattttttccgtaaaaagagacaagaaattagaagtgataatttctatttcaaaattgattgaaaaaataattttcaatcacgtgtcatctttctatattggagagagagagaaaaaaaaaagagtgagataagaaatgaggattgatcgattgcatatactttttgaaatttgtacaatacccaactaaaaaaatatatgacttgtcatcattttctttctctttatgcatgtgaggtgattttctttcttattctttatcatgttaaattaaccaatatttacatttatgtggaaagatgcgatgttttcaaactggtagatgacattctgatgagagaacgaggagcaggtgcagcagaaaaacatttcccttcaagaatctcattgcaactcactcccacaattcaacaacaagtattaaccgtatccgttggcaaatcctcagagaatccacgaatagagtttggcgtggagaaaggcatagaagcctcattcgagccaccaaatccttacataggacttagcgtatcagcaggagagtccacaactctgagcttaaagccctggaaattcgagcaatcagttcatggctacagtgcaaacttgaactggtttcttcacgatagcaccgatggcaaggaagtgttctccacaaagccttcaaaggttgcgttgtttaacccaaaatcatggttcaaagacaggtatccatacaccgtcactttaatgaaattactaataattaaataccatgattttttaatgggattttcttgtcgtacaaactcttaatttttatgaaataaattatttttcattgacgtactcaatgagagtcttggatccggcattaggtactcgagtgcttatcgtcctttcacgaggcaaggaggggttatctttgcgcgtgatgagtatggagaaagtgtgtgttggaaagtggacaaaggtgctgtggggaagacaatggagtgggaaataaggggttggatatggctaacgtattggcctaacaagcacaagacgttctaccatgaaaccaggaggttggagttcagggaaacggtctacctcaaaattgcatagcttaggactcacgcaaaggaatatatcaatcaactttgatttggactatagaaaccaatttattatatcacaaatatgtattttttttctttattttattgaacatgtggttaattataattgtaaagtaaatgataacggagtgaaattattggtctgttttcatttttcacaaacacgcgatcatttccatgggaatttaattttaatgactgattgtaaaaaatttgtgttatcgttttactactattcaagatgaaaagtcaatttatcctctttaattcatagtcatgtgtccattgcttcttacatgaatgtaatatatttaaagtttttgtgagtgtcgttgttggtgtggtcatttcatttttaatttatttaaatacattgatcattaattcgagcactattagggaaaaatatagaagaaagtatttttcctgactattcttatccaatttgaaaatttaaactgctatcaattataataattaatgtgatcatgttagaattggaataagttgacttatctaggctatgggttcttttcttgtttcttttcttcccccctcccgaaattaatgatactatttatttggatgcttaaaattagaaatcaaaattatatttctgtattagctgaagaagattattatagtaatttttttgagaggaagattattatagtaattgagaaatactgcttagagcttacatgttacaactttgcttttctgaagaagaaaaaaaaatgtaattaattcttaatgaatgtgagatagcacaagatgtgcctcgtgtcaatcgaagaatcccctatacaattaaaacatctgcatatgcaatgcattgtgcatccccatcctaccaagcacaaactaatatcctagctatgtccagccattagcatcaacgtgacatgtaagtctaggtggaacaaaaaataaaagttaaatcatctttttgatcttttatgttttttattaaaaaaataattttaattatttatttttctaaaataattcaaaatatcatttcgttaatttaaaattaatactgttaattagtatttagatacttataatttttattcgtcacaaaatatgtttttttttctttctctttttctcccttaaaaaatgtgactatcaaggtaaaaaactcttctccttttacagataaaaacatatttaattctaaaaataaaaaggaaaattataaaaaaaaatactcaaaataaaatagtattataattttaaaatattaaaaaaaactcgtgggagtttcaagtctaatttaaacaaatcactagttgattattataattgggcgcatgttagctggtgtaaaattagaactagacatgatcacaggagaagaccaagacattgattttctgatgtacttctcacttcctcaaaatcatttatgtactgtcttataattaaaagaaattatgcaaaaaaaagttaaaaaattaaatatattatttatttaaggaatcaaattttaaaaaattaaattaaataaaagtattttaataaatatatttatcaagaatggaaaaatgtacatactcatttatatctccattttaaaaagtcaaatattacttatattcatgctcgtgtcccggagttatccatcaaagtagaagttgagcaagctgtacacacagtcaatgttatgaaaacaggttcgaatcggccggttggactgggaaccatgacatcactcgggccgggttggttaatgaaccggtcatgcatgtgaccccatttggcccaaagaaaatcagacgattttttaaagacccgacaacccgaccgatttttaggacccaggccgggttagtgtagaaaaaaagactccaaatggcaaaatggtgtcattttggtgggccatagggtaattttttatttttcctaaatgaaatcagctctccacttcttctgttcttcatcttcattcgttcacgctcaagctcaccgcagcagggttgttgcttcacgccatctccgtcgtcgacgtcgtcacaacttgacgccatcgccatcgcgcgttacgccgtcatcgtactctcctccgtctcgcacacaaggcttcactgtgcttgtcttgtatgcagtggcagacccagaatttttttttttatgttcgcacacttagtgtcactgcccccaaattttttttgtaaagaaaatttaaattaatgctttatgtataggttatgaatccgtacaaaatacagttgttttataataagatacagataatagtttgactaatcatttaacctttcaaattttataatcctccaaaacaaatataaaaatatattctagtacatccatacatcatcattttaaacaatattctaaaaaatactttcctaaaaatattccttcaatacatgcaaaaataataagtctctctacaatttttattttttcagaaattaatttgttatacacgtgtgtatatatatgttaaaagagtaaagtagtcatttaaaaaaaatgtgtaggtcaagtaaacaaaaagagtatttttttatataataagccctatccaacttgtgggttaggagagaaaaaacaagaacagtaaaataaagtcttgacaaatgaaataaaagcaccgaaaggtatatgtgtgaaagagtggacttttgttccctagacaaatgtcagcccggcgccttctaatatttctccaaaatttgtgtccgcacttgcttacagtaactataacgtgggtctgccactgcttaggatttattatatatatatatatatatatatatatatatatatatatatatatagggcttagggttttttttttatttgggccggatttgcttcttgcactccctttattgcttattgtactttttctggctcatttttttatattaaaaactatacttgtgtttaatttaattagttgctatttacattttttttattaatacattttacttgtattatcaactttaatacttatatataatataattttaaatattttaatataaacagagttaaactaaatcaattaataacccataaattgaaccactaacccaccaacctaatatttggactaagttaataatcaggtccagttttataatactggttgcaactattactgctcactgccttgactcaaagcaatatcataaatatttaacttactatggcagacacttttaatgattggcaagtttacatttactgcgctgctactctaatgtttgggaacatgcataggcatagctgtgattaattccttactgtatttgctgttcactatttgcagaagctgtgggttacatagaccctcttattgctgtcttaccgtcattccagaatagcaagtgacctagcccatcttattgttgaagattagttatgcagcattaatttgttggggagctgagatgcaaatttaagttattctttctattctatagcaaaatagcttgtagttacactaccgaaagtaattaacgatatattcagaaataattatttgtgcttatatattgggcaaaggggtccttttcttgaagatcacatttggtatacagtttactacttgcataaaggcaatttcaaaagtaaaaacaatggagatatttaaataaaaactgaaacaatatgctgattattctcactttactttttgctagcatttatggaaaagtaaattatgttgctttcgcaaaaattgtagactgcggaccgaatgatattggagtgtatactagagctaatatacacacccacaccacacctatcatgcatccaatattccaattcatcatgtcctgtctttagtttttactggtaatttaagatgaaatttggtttgagtgtttatttttatttttatttttaaatttttaagatttaaaaaatgtatagaaaaaaattactccaaggtgtcgttacatttttacattttcagaaaaattgaaaatattaatttattgtttttagatttgggcctgttttcaaaaatatttttagagaaaatattttcaaaattttaaatgaaaatatttttactcttatgttctattttttttaaatgaaagcataaaacactcaaaccctacctaaatagatctaattacttgtgggattaatccttcactttctgccaagaaatatccatgttcatccaaaccaaaaactgaattcatcgtgactaacactccgaattcataaatgcagtgaaaagatttgtgaaaaataatgataattttatttcgatttaatgcttttccaagggaagctgccttcatatccaagagaaggaaacaaatgaacttaaaaggcagagagagaactggtcttgcctctcgagaaattattggagagaaaatatatagggacacgacattatcttatttccccgggcttaaacggatcttaaagatccttttaacatgctccatagcctatccaggccttcatctttcgtttgtactcaacagcaaaacttaaagcactaaattaatacgcttttttcttgccatataatatcataatgttgttggtctggatagtatggaacttgaattcctcaaggtagtgaataggttctctgaagaagattagttatggacaaagctaatgaatatttcgctaatgtcatagtgacaattttttgttatatatatatatatatatatatatatatattatgttaataatgtctaacctattgaacaagctgtaaactatttgaagcatctaacagcagatttactgttgtagaggaggaggagaacatacatagttatagagattcatggaaatcaatcttctcaattagattttcacatgattttattatgtgaaaaatttgtgtctgtacttagaggattaaaatataatgaaacttgggaagaatgttgccactgttggtaagtcatttgagattatacaagaggattatacattaataaaaaaaccattgtcaacaagaggattatacatcaacattcagtcttttctagacccagctcctcactcttcctttgaaccagcatttctttgactttgtgcaaggcattttcaagattctccaactgcatatttggcacaattcaattagtctatctacatttacttgttttactttccaatattttcaaatttaatagagtgaatgcctatattttcctagtacaagtagacagtaatggatactatattttgggaaatagccatctggatggcagttccatacctcttgaacagaaaacctattatgtaagaataatccactgtacaagtcaaaactgtctctgatggtggtgtccttctgcaacaagttgtaaagaaccacattgataccatgcctagttgcaaaccaatatatgaaaggaaaggttttggagggggaacggggaaagtttgaaaacaaaatgattgaagatatataccaattgaataagtgtatgaaagccttttgtatcaataggtgtggacttgatatccatttctgccaatgtcctgattaaaaaaaaaggccaaagttgtacctagtgagcatgcatattagtatatgtgtttgtacatggttgatggaaagtccacaagttataaagtgcagaaggtagcatatacacctgcctatagtgtgtgtaataaattgactcttggcagctattttatcatgttcctcacaagacatttgtagcatcctgcagccctgttaagaaaaacagggtgaaatggattataaatcaccttggataaaagtgaggtagtctcaataaattctttcatgcttttttgaaatccaagcagtagttccaagaggcagttaaaaacttgctgtgggcaagagttctaagattgatttgtaaaaatatcttggcgaagcctctatatacatccatgcctatgctacttgtgccatgttcctattaatttttctgagttgtgatttttttttctgcactaaaagattttagaatataactaatcttaaggtgatattgtccaaagctaattcaaagctttaacttgatgttttattagttttcttcattggccgcactattaatttgcaaggttttgttattgatggcaattgactaaggcaattaacgtacctcacttgcaaaaatgtggaggaagttagagcagatagcttcatctcggattcgaactttatcatatacgaatgttagatctttccacccatccttcccactatctggtccaaacattgggtgtgtgcacagtatgtctgactcctctggcaatacctgttatgaaagatgaaagcaatgtccttgaaacatgaattgaaaattacaatggagaattctatgtgatggcttattctgtgtaaaactggtttgacaaatttgttacatttttaatgataactagctgcccatgattataaaacaccaaatttttccattcattattgattttggtctgcttggagaagagaaacatagcttattcatacaaaatttcagttattatagagtttgacaaaaatccagttattatagtttgtaatgggtaaagctatcgccatttcaagggaggagaaacatagcttgtttattcaaatattcatcccaagcaaatccttccttcacggattattaagaaatagaccttccctaatatcgcctaaaagacaagtccaacaaaacttaaatcacccttagattatttcccctcccatataatttcaccaccaattcatttttataaaacttaaataccatgaatactagtattctcacacatttcttccttcatacaataattcattctcacctaggcaaacaaacaaaactagagggatcatcaaaatgaagctagtaaaaaattgaagtaccttaagtagaagatttcttgggtgctctttaactgaaaggacatcaacaaagagtgttggtcttctgagacaagtgagtggcatagagctgagaacctcggagagagataggatggccgtacatatgagtatgacatcgttgtcagcctcaaggaatgcagcaacatccctgcagggacacatgacattatgcaacatgaagattgccatttattatgtacatatattcaagcaattcaatgatgatttatgtatgtacctgaagaattggatacccattgggaggcataagaaggagtagtcagtacgcgaagttgcccttagagtgtggccttgtttgatcatagtctttgccagaaattgcccgaaggaaccaaacccaactatgccaattttcagagaccatgttgacatgattgggttctaatgttctatggttgctgttgttttggtatatggtctattctgaaaaaagcatcagatcggatcgaggtctaacttttatacttaggtccaactttaattccatcaaaatctccttgcatttattcggacaagattgttttaagataatattgtaaattaaacatttaaaaaaaaaagaaattcataatattgtaaattaaacatttaaaaaaaaaaaatcataactactgaaaatttaagataatgctagatataagatgaaatctttacgaatgctcagaaaaatatctatatgatttagtatttgatatgataccgtctggtagtacattcatttaaaaaaaagaagttgaaataattttattgaataatattttggttttaattccagaaagcgttagtcaccaagagacaagaaaatgcatgaaataaacgagcaataatatttcagaatcaccacagtcgtaccattaacccccaccaaaaaaaaagattcataaatttatctcatttatatgattttagagataattgctttcatttaaatgaaaacttagactctctttttttataatattttctcatgtttttagtatttttctgccaagaggaaagttaaaaacatattaaaaatttagtgaagaaaataggtctaagaaaaaggaggcccttatattttggaattcttccattttaaggctatgtcttgaagcaaggcgtgtcatgtgtgtaaactctagattgcaaagtaagatggaagtatatttttgtacaacttggactataccagttaggtgaattagccattcctattctagactcatcagtcattacctcgggccaaaactgcaaaaaatcttaaaattatgaaaataataataattcttattgattcggaaaagttatcaaagtgaaaatttatcagcatataattataggaacctagaatatagaacctaaaatttttcttgtaaaaatagaggaggcaaaacactaaaaacaaaacttgatatttttaattttatcatcgtcatgaggtgtacaccctcaagtatatatcaaagttccccgcaaatcagaaaaaaataaaataaaaaactaaaagttccccaggacctccactccactatacaagcatgtatagtatttatatttatattgattacttctaggtctgattctttgaattttaaaataatttataacaattaaaattaatgaagtgcattgaatctgcattggaagatttccttttgtttgatttatgctaaatgagtatatttaaaaataatattgttttctaataaatatcatctttccaaatgttatttttaaataaattaaaaaaaacgattgttaatcaatgtgtttaaaaaattattttgaaaaacatgacactgtttattatgaaattaacaacacaacaaacaaaatataacctttttttataaattaaattactcccttaaaaaaaagttttttacaacttctaccaaactcatgcacgttcaatttcattttcttcaaataaccgtacactttaaagaaatcaatacacctaaataattaaggatttgacttcttaaagagatttgtttttgaaagaattctaataagaactataattattaattaaaaagtttaacaattaatattataattaaaaataactatatagttatttaaaaagcaaccgtaaataaagtaaatccctctctccggcctaaatcgtataattaattattatgccttggtggtggttataagtttttgacttttaattttttaatgtatttttcaaaataaaatacattcagtaaaaatgaaattagattgattttaaactcaattttaaaataatttatatttcttatcaaaatataaaaaaaaagttttgtgaatttgatcacattaccttaccaccaccaccatgttcataatttttaaaattggtgattgattcaatcatgatccaattggtaaatcattaattaattcacatgacttattttttattaaaaaattatattcaattttaattgacttgcataatcagcatgttggcatgactcacctcaaattagtgggtcaccaaattaatcacaattttgatcgggttgtatctgttcaatgcatgattgattaatcagcatgttttctcccttggacataatttttttttttaaaaaaaaggaaaaatcaccccgaaacggatctctctctctctctctctctctctctatatatatatatatatagtagtttaggacggggtcaccgaccagcagaagatgagaacgagataaaaaaatgacgtgtaaccttgtcaacaatgaaatgatggaattgtggtaaagtctagccttctcggcccatacccaatagctgaatctgaaataaccgtgtccagggttatctatctatctataccacacgcatgtcacgtgcgtaatgtagttgaaataatcgacccaacccaagtcttctatgtcctcttataaatacccacccaacacggagtggataagcactaacattattcctcatccttatcctctttccttcaatggaactcatttccgcttccagtttgaatcccaacgctccgatcttcgtgccgctcgcctatcgaacggtggaggatttctccgaccaatggtgggacctcgttcactcctccccctggttccgcgactactggctccgcgagtgcttccaagatccccagtaccaatacgacgacgttttcgacttcgactttgacctagatctccgtaactaacttacttacttatctccattttacttctctcatattcatttacttttctttttaatttattttattcggatggatgcagaagatgaagaagaaaatgaagggaaggaagggaaagaggtggtgtcgttgggggtcctcaaatggcgaagctgtggaggaggatgggccgaagcgccgaggtatgtggaaaaggcccctaagtttgtgaagcccaagctgagcccacgggctattcaccagcccaggtagacgccacccggtccattcccccgccaccaccagccatgtacataaaaaaaaaaaaaagtgtcaagcgcaatgacttcgtcttcagagctttctttacattttctagattttaattttcgtgttgatcttcttgttactctgatgttccataaagataaactcaagtttctttgataatgacgattgctcagcttgtgtccgtgttcagatcttaatatctgcgaggctataagttctaaattttattttgccaaattttaataccgagataacaaaatcgtagtatgatttatgggcgtggcaaattaattcgattattttcaaggcttcaataattttattttcttgattgaaatgagtttactttttacacgttacactaaaacgaaaggaacttactatccgtctattccgtgggttaaattaacaacagacgaaaggatcggacaaatgagttggctacagatctttttacatttcccatgatatttttctataactcctagaaacgtataatttttaaaatatccaaaagaacatttatatttttgtataatagaaaaggaatactaagaaaatacaatggtaaaaaaatgatttttttttgtatttttaaatttttcttgtctaatttatcttaatttaatatatatatatatatatattaattttaatttatgttagaatctaaatttcttttttcttcttaggaatagtcttggagaagtttatatacaaggaagcaatggaactactagaaatgcggctttaagataaataaataatatatataaaacaaaaagtagaatcgcattatatgaatcataaattatatattatctttaaaaatatttttttctgtcctttttgttacattaatagttctatcttatttataacatttttataaaacaaaattgtactatatactttttcaatcgttttcaatgcctaatttactagagaccaaaacaaaatgcccattgtgttcacaattaattgtaggtaaagaggcaaatcagacacaacacgaattctttcccataggtggcctaagtccagaagacaaaaatatcaaaaacatcaaacacaatcctataagatcaagttgttagtcaattgacacaaaaatttccttgacgaaagtcagatagaaactaatattttactagttcttatttataccggtgtgtttggaatctgttacagctcagtcaaacggagattttccactttataatgagcaaactgcaaactgagaaggaggaggagtggtggatctacgttcaattcaactgaatggaaatacaaatacacttgtgcatgtttgatttgctgttaaaattactaagatacgtgttctaatataatctaacatgtaaaaataaaatgaaagtaagaataaggatcctaatccttttgtaaaagtacttttgccttaaacatatttttacacatgatttccaaacatattattattaaccctggacagtgaaaccttcctcaagttataacatcttatgcttacatcaaacacttctgttattttcttttctttttcttctttgtccaacaagaaatatgacaatttgtttcgttcctcttcaaaataagctctgtttttcaattgccatgccaccaaactgacgtttgactagaagtaatagtttcttacttctcattgaactaaactttgaaacgtgtgattttccaaacgaactatacacaaattaagatgtgtttggtttgacgtttagttgaacatacatatatttttatataagttttgtaagaattagaaattcatagttttttattcaacggccatttggagatttttcgacagtaaaccaaacacacattaaatatacactacaaacaaatacctttcctagagcttattttcttgaccatcaaaatattaaattaattttcagttaaccctcccaattttgtattagagtgaagttatttcataaaatagataaatgtttaaaagtggagttgtcattacatctcatcaaatgtacactaaagcttctcagtgcaatctagtgtattctttaatacgctgcagattttcatctatactccttcatttctgggttttcattctggtaatactagaacatcaacagtatagatgcacgagaggtatatcatatgagacaaatacaacaacaacaacaatcactatgttgctccgtttatgttgctccgtatatcacatgagacaaatacaacaacaacacctccttcatttcttggttttcattctagttatgatttggataagtactactacaaatcacaaatatccaatttatgttgctccgtttgtcacgataaacagcgttaaacaaatagagtgtatacaaataaataggatttcttatttcctttcatgcctcttatcagatgctttatttggagataaaggtcgaaaattacaaaagttggaatagatatataatataaacctcaacaaactctacatagatgatatgattttacttcgtgcgtgataccatatataactccttaattatatgtttcttgaggaaaaagaaaactttaaggctatgttttataagtggtaactggaattgtgaattcagcaattgggttggggttgaggattttcccagggggtagcattcttgccaatcttttgaagaactctaatcacttcttccgttgtgacattgcctgtaacgatcaccttgttcaactgcttgtccacgttatacgtctcaatatctgcaaggtcacgggtcgcaaattattcatggaaccgaaagaagttatgcttgcaaagcaaattacactttgtagcaaagagatcatcataacaaaagttgtgacctttggaaattaattagttaccttcaatcttcttgatagccttaagaattttcttgatacactcgtcacagtgtaaaccaaccttgacttccaccacctgatgacacacaacaagaaacttttatcagttttctgtcccatatatagctgaaaacaaaaggatcaaataatagctagtaagtttctcacatttgccattctaattgtctgagtggaaaattgatgcaaagttaatgtctctgatgttagaagccttgagcaagtagaagaaagaaaaagggtagggtgatttttactgttttaggcacagtgtgacatacagccatacttatatgaaatagcaattagtgaagacagaatcggattctgtacttgaaagatggaatccctcactttctgtcaataaaaggtgcaagaaagtttattcttaacagttgacatgggagtaactggcctccactcattcggtaaggttggcaaccacaaagtccctgttgggtttggccaaaaaactagtgaacaaagatgaagaggaatgaaacaagcaactaatataattcctccagctttcattagatttgtgacatttgtctactaggataacaaaacaaaaatgctaaatatataaattcaccattgttggaaggttccacattgtctgtctcaatttttgaggtgcaaacttatttatatatttgttggacaatttcatttaatgttaattagttttaagatgaaatctaatcactatgatggataattcaatacaaatagaattataacatatattatttcatatttacatatcaagaattaaacttataatcacatatttaaggattaaaattatttaccaatcatatcaatcatgtgattcgtatagtttatgacaatattgttagaaccttaacttgtgcatcacatttgacaagtatcatactgcaattttatttatttatttctgtaaaaatgaattggattttgaagactcggtgtggtttggtttcacttctataatcatcgaacgtgtattttgatatggacaaaggtgagtttaatatgaatgtgaatagtaacatgcatgtttggtggtattatcaaagttcctaggtctatgatattcttggattctttggtgagtacgatcaggtggatgctccttttcatgaattttgggttatgctgattgatgttcatgccttgaatagacattcctcataaattaatcatacacttgaagctcttgatcacagaccagaaaagcttttctaagagagtcgtccatttgttcaagggaggattcaattcattagatttctataatgttacttttttgcaacttgcgttaccttaattacctaaagcgggcaccaggaaaagttatgcaccaaataaagtgcaccagtcatctatttataatgaaagatttgtactatttgcaaaagaatttctttattacatctatcattttggttatatttggtacaattaggcaaaaaactagataaaaaatgaaaaattagtttatttaattataaatatttgataaaattaactgttaaaatcacataaaagtgtacaatgacaaaaaaataataaaattatgatttatttaaaaagaacaactagataattagataaatatagcatagataaaaataaaagaaaatataaaaagttaaaaattaaattttaaaaaaatattaatttaagtaaaattttaaaaaatgctaatagttagtaagaaattactaaaaaagttattgatctaatagttaaataaattatttaacaagtaaaaaaaaataaaaaagttattgaaatatccagtcgaatatatactttctcactttttttctttctttcttcctcttctctattctttaatataaaatattataaatattaatgtacagctaaatttctcataaattaatgtggagctcttcactgggcatttgaaattgaccgtgcactgtagtgtctttttcccttcctatctctctattgctgacgcagcgccaaccttggcagtagatagttagtagtataatagaatggctagttggctaccacactaactatatatttatatgaaatgtgatctgatcattaatagataatgaattactggatcagtgttttttaatcagtcagttattaattagtctagtttgatattatatatgttaaaatttaaattatatatatctattatatataagtatataattaatattatttgagtatgaaaagttcatctatatttcaaaataacaattgataatattccaaaattcaaatatttattaaaaaattcaatatttttatttttatttttaaaaaaaattaaaacacgaccaggtcagaccggtccaatcgagatccggtgacctacccggtcgagtttggtctggtcatccccggatcaattgcatgatcagtccaatagtaacactaaacccgttaagctaccgggtcctagtctgaccagtccgaccgaccagatcgaaccgggttcaataacacttgtatgtacaattattagtcttttgaaactttttcataccaattatctccatttttgtgaaataaaatatctcaaaagattataatttttaccttccaataaaacaaaaccatttatattaaagtacgaataaaactcccccacattacattatctaattttccaaccagtcaaccaagtagtcacatattattagtttttaggcttaaatatattttttatacatgaaaaatagatcgtttttagattactacctcaaatttatttttggtcaattaagtgcttgaaacttttttatgtttcaacataatatctgtcattagtttcattttgttaagtgatgacgtgatagacagagtgtcatgtcatcaagtgtaatcactaacacatcaatgtcatgtcatctccttctttcccttctccaacgaaaaccaccaccatcgccaaccgcaccgtcaaccaccacaacaacaaccatgtcctcccttcaccgcaagccccataaccgccaaagcaatcatcctcaaaaaaggcctcgacgacatcctctcccttcacaattgccgctacaannnnnnaccccccccccctcctcaacttcctttccaacccaacatccaccactttcaacttggactccaactcaagcccttccacctcactcgactcaaccaagttccaactcgtcaagccctaccgtgtggtcctggtcccactctggcaagccctccttaagtccctttgcgcctcctcctcctcctccatcatcttcgtcaactagagctccttcaatacctgacgcactccaacaaaatcaactctccaattctacagaaactatacgtcaaaatcgagaccgataaaaatcgaaatcgatggccatctcaagaatgacattgttttaggttctccaaggcaagcgatctgacaagtgccatgcaatttttaggtatggctcagagcaacagactgaaccctaagcccttgacggcgcaatcgacagtggtagtttctgttggagaagggggataaagagatgatgtgacagtgattaggcttgacgacatggtacttgtcatgtcatcacttaacagaatgagactaacgacaaataatatgttgaaacataaaaaaattcaagtacttaattaaccaaaaatgaatttgagatagtaatataaaaacaacctattttccaaatatgaaaaatatatttaagtctaatttttattatactaatagaatccaaaagtaatcatttaatgaaattgtgataaaaaaaatattaaaattagtacatcaaatgaaaatccaccaagggtgtagcatggttgaacagtgtgcataaaaactctaatatcatctttgatttctacatataaaataaataaattaacattcaatagattaacaattcaaaatatattttttaaaagtatcttttaaaataataaatataaacatttaatatcttgtaaggctaattaagatccattacacattgtatttgtaacttaatttgaataaataatatatacaatttaacagtatcatttaatcataaattatcatttgtaataaataaattgattttctaaataataattattttaaaagtaataacaattataaaattctgattagtttacgtgtatctaaattaaactcttcaaacttcgcacatgccttggtacaccctggaaattttaaagatagcatcacattagttttaaccacgccatcaatggcccctaaaccaagccataatttcttttttatactcaaaaagcgtttccaacatttcacgttaaaccgttgacgaagacctgccacagtttctctccaacagcatcatcataacaattcgaaaaaaataagaattcacacaacagccaatcacaattcgacacctgttcttttttttctttttacatttccctctgtaaagtaacccgatcccaataaaaataccagattcgttgccacacacccctagattttctccctcttcatctcttccaatttctctcatcaaagtttcgacctttgataaaattcaatcatggggaacgccctgagattcctctacagccattgctgcaagcccacagcagctggtgattctgaatcacttgggccacacggtgtttcctctgccaccgttggtgtttcagcacttgcccatgatctctttcgctttgacatcacctcccaggtacatgcatacacaacacatgtgaatcctccaatttggaacttacactttgggttattctgttttttcaaccaatttggcatagtggttttgtcaggtctttatgttttcccttttaaaatgtttttaggtcccggaaggactcagcaagcatgttgtgtcttctaagaaggctcaggctaattggtatactcaccacattcttctcatcatgaccctgattggaaaaacttaataaacacttgggagaagaaaatatgaaagtaaaatgaattaaacaacttttataatttatacgttaaaattagtttatgtataaggtgattatacatgttctctcatttaacttctctgcttgccgatttaacttactagagaaatttaattcactttattttcttattttcttctcctgagagtacttattgagaagattatccaaacgggacttacattgaatactataaaaccttcagaagcctttacctttgaactatctatgccctttctgttccttacaatgtttttgaaggtatagaaagttagttgatgcttggaaagaagcaaaaccccctcctaagacacctgaagaagctgctagacttgtcattcagaccttgaaaaggcatcaaaaagcagatgttgaggtttgcatgtacttccattccaaactatgaatttgattgtgttacctaagtcacctaatcacaaaaacaaagctcattgtggatggaatttgtgttgcttaatttatagggattgttggctttctatggtcttcctctaccacacaccctcgttcaaggaacttcccaacccccttcatccttgcctgacggagttcaatttgaaatgcataccttgccggtaagaatttaacatttccattcaatccataaaaataaagtcataaatatacttgagctgaaaatgtggtagttgacaacatgacattttcaatgggactaggttgatgcaaaggcagtagcagatggtgacactgtaacagtctatgttagcacaacagacccaagagaatcagcatttgtccctggcaatgtgcatgcagccaccgtgcgaagatcagaagcgcgtgcacgaaggaactttacagaagccgatgcattgcacaaacagatcattgattcaggatatcggttggtttgtagtttcccaattccttatgtctatgcttctaacactccatatttttcttctaattgtttgcttatttagggtgattcctgttcaaaacgaggaaatcctagctaagaagtataggattcgattaaggtaatgtctaaacaagcactagtgttaagagtgttgaagttgttgtggaagctattaatgaactctagaaacaaaacaggggaattgatgcaccagaaagtgcaatgccatatggaaaggaagctaaaactgaactgaccaagattgttcaaggcaagcctttgagggtccttgtttatggagaagatcgctatggtcgttctgtaggtgatatctattgtaatggcatttttatacaggtattcatttcatgtatacattttgtcattttgctctttatctatatacattaatacatgtttgatgtttctactttgtaagtttctcattttgcttttcttttttgattaggaaatgatgttaaagaagggtttagcatggcactacacagcctatgacaaacgaccagaactggaaacagtaagtaacccatgttctggttctttcattatttttcaaaggtatatatacatcctaactttcttaagttcttatgttagtgggaaaaacaagccagagcaaagcgtgttggattatgggcttcaaaaaatcctgagaagccatgggaatggagaaaggccagacgagaagctgcataacagcgcctaaaatcacacaagcagaattaccagagtgccaaaagaaattgagtttctcagtaaattctagggaaaaactcaaacaaaaggcccttcattcattatgtataattgatttaacaaattgtatgtatacaaaacaactgccaactaactagatctatttttcaatggtatgcttggatcattagcaaatctgattttaggnnnttttttttttttttttttttcaaatcaacacactaatctatattaataataaaaggaaatacctcatacatatttcatttagatcattttatcctttgtcaatttttaaatttttatttcttctctcctaataattattcactattctcatgttagttttttcttaactttatatttttttatagttaaaataggtaaagaggcatgaagtgcctctctccattagtcgttataatgttgatttagtttttttacacaaaatagttgaaaaaatgagactgtttcgcatatcagtttcatttctagataacgtagagattaaaatcaatcattaaattagaatattacttcttcaaaattgttgtgtttaataagagtattgggtaacaaacagccatttacaaaattttctcttcagctagtgcagcattttctcttaacgtgagataaggagaaaaatgaaaattaagggcacagctcaattacatacattcaatatgttcaatccaaagctgtggcttaattagttggtctctctatctgatcttaccttaaaactttataagatcatatatgaatcataatgatctgttgttttttttaatatttgttttgctaattttttaaaatatttagttataatggatttgtgaatatcatgttatgtgtgcatgacatctaaagtgccaaaaaagaattgaaaaaaaaaaaaaaaaacttaaaaccaatatattattttatttcatttgatgcctttctgttagatgcttttattcggagataaaggttaagaataaaattgaaatagagatatacttatacctctgcaaactcgacataatagaatttcactttgtgcgtgatatataaatctttaatttgtatgtttcccggggccaagaaaacttgaaggctatgactgtgtttggaaacattttttttttaatccataaatgttgtattctgagtttttatatttttaattttaatcaaataattgactagattcaatatttgtctattaatgatgcaaaatttttaaaattcaacataaataaagataattaagttgaacacattaaagagatagaacacaaacgcttggggtggtaattgtcggttgatgcagttttcgtgacatgttgggtgttcgatctattgaaactactcttgatgcaattttagagatttttttatcatttaaagttatttcaattattaccttcattcgttaacctaccataatcatgatctctcatgtgaaagagcctatattacctaattctttcctaatcccttaagagctacatcaaataatttgctttaagaataaatatctataattaaagctaaataataccattttatccctaaacatgaattacttagatacacttttcaagttcttaggatgcaaacatttctcaataagtaaatcctataacatacatctgcatgagtgatcaaaccataaacaagacaataaactcataaaagaagcattaatattaaaaaaaatattaaatagatagtgagaatcattacatcaaaagtgtttgtttgataagcttccaacaatggatgatttagcctctcattgtcatgagagacttacaaatacaaaaaggaaacaagaggaatggaagaaaatggaggaaagggtcctcaagtgagtgagtttcgtcccttctctctagccctagccctagccctgtgttctatctgaaatccccttttggcatcgtgttttccctctttttatcttcaaaacgctacacaataatgttgttttgacaatgaccgtgtgctaagcatgcatgtacgcattgagcgtacatgcaaagtccaactgacttaagtgaccacgtgctaagcagtcagatgcgtgcagcgtgatgctccagttcttcaacatcttccagacctcatgctatatcactttttacaaaaaatagaatcaaaatattgtaaattttctaactttagcatccaatgaataaaaattcagaagaaattaaattcctaaccttttaactcaaaaaaaaattaacagattaaaaaattaaataatctctttgtgaattaaatatacaaattacatatgcataacaattatcaaattgtttgttaaatctataagtctaaaatataatttatatatactatatttaaaatatttgtttattataaattttagttataatagaatttatatattttaaagtatttatttgttgtgaattacatttaaaattataatatataaatataaatctttatagaggtgctatacataagctaaaatactagatatctttaaaaaaaattatgattatactattatattcaaatttaaatcaaattaaatatttttataataagttgatttattaaaagataaaataatgtgattttaatttacataattaaataagtgtatataaataatatttacccatacatttgctggagttaaaatgcaaagtaaagaaattatatttcagtttaaaaccaaacaagtgtgataataaaattaaatcggacagttgtgtcctaaaacccctacccaatccaatacacaaacataaataatatttttaacaaaagatgctgattgctgagattgataatagttccttgataaacaaacataaattaaatctattgttaaaaaaagaatatctgaaaaatattcactagattattttataataaatgttttaatctataacaaactgagaatataacagcaaaattacaccaacacaaacggtgcgccttgtattgagcgaggaaatctgtacagcatcatttcatcaaggcttcggtcaatgctttgagatgagcagggaaactccacggcagtgaacgggccattatcaaatacaagttggaaaaccaagattggttatatatacacaattatttattttattctcacaagaagtaacacaagttaagatttaagaatgtacaatgctctctacaaccatttcctctgtcgtttaaatcaattcacattggtggaaaattgtaaagaaaacctcaaacaagaaagaaaggactttggtttcacacagacatttacccaattagttacacaatgtgactcataatgaacatctaaaatgtacttcctaacataaaaatctgggttgattatgagagagctaagaggataaaaacatgaattaggataactaaaaatttaatggaccatcccatataacgtcatgtttatggaagcagaaacatccctggcttttaccttcagggactaaggagattctctttgtattgatggaggagttggtgggttcattgtttcatcattgcgggtttcagatagctcttcttttacagtagatagtggcctctcagggctataatatcccttaacgaaaccgcttgaatttagaggactagatggcttgatcatagaaggggaagagttgttacccaaaggagaacttgtgccagatttggttgacgtcacatcttcacgaggcaaaggtgacattagttgttggtcactggaataaacttctttcctgcataatttatcttctataatatcatagctattccccgttcgcacttcttgagcaagagagcaccagcaacagcataaccaaagtgtgcaatcagaagctgaaggcttgccgaaacagaagttataagaaggcaaactgaacctttttctcatttgaatcctccaaaaaccaccatacagaaagccaaaaagacacagaatgatcccagtagctactagagcctgcctaacagtttcatcctcaatattcacagcagccaagataaaaatccaaaagggagccatgcaaaacagcataaaagtagcaatgtgaacatacatgtttccaaagccaagtctctccatgttccaaccaaagacacaaaaagtacagaaaagtgataggtatgcttgagaaatatcattccatatgtcaagtattcctccactccactgtggtctagtttcgataaccctttgttgctgtctggatgcaaatgaatatttcttctgaaatgatttcactctcagcggctcttgcttctgagcaacacaaccttgaacctgtgcttcttcatccatctcagaatcataatctttacctagagggctgagaatggaatacagaccagcgactgcaggtgcaccaattgcaacagatatgcatattccaactccaatggccgggcggtccgatcttttataccctaagtttagaccacaaagtgcatattgagcaaaacagttcacattaaggagaatgatcactaccatcatgtgtgcccactcatggggcttataagtcccattcttgcagtaaacctttctaagtcttgagatattttgtggactccgcctgcacagaagcacaaggtggtagatcctctttggatgctggtacaaacacatgagtgtaaacagtgcattgagtatttgattgttcacttcaaaccatgcgtttctctgcgacttccttggcagcacagcattcaacatgccagtcatgacaaggaacagaattgcacctgaaatgacaacacacaaaatccacacaaagagggctatgttcattgggtccctaaaccattctacacacatcttcttgagtgaaacccagtcaagtttcttcgcaaacatgccactgaagcgctctcttaacccaatagaacccggagaaggcacgccttgagaaatctgttccttctcagtagcaagcctcctgaatttggcagatgcagaaccaaatttcaagaagttgatcctattgggaatagaactcaaagtgccctggaactttctctgaggactttcattgccaaccaatgctcttcgagaagttgaaatatctatggaagcaaactccgtctctttacttccgttagattcctcaatttcatttttaccactatcaacggaaaccattctgatatgaagcctgagccttctcaatcaaaaccattaccttataatcaatgttaagaacaaaatcagcgtggataagaacagaacatttatgctaaattttcaaatccatatcaaatttcatgtgaatccataagcacaaagaaaaaaaagatcagactttatgttaatatatatgtgtcgacgacccagtacacagatcattatacactttaattaattaaaattcacaaactagaaaaaaaaatataattctaataataccaacaaattcatctcaaggaaaggagtaaaaaaaaggaacaaaaacatcaaactttgaaggtatgaggagttaagtgcaagtagaaaggtgtcatgtaaggtgagaaaagaggaagaaaccgttgcatccaaggaagagttatattctctgcaaaaatcacaaaacaactaacgaatctaaactctggaaagttcaaactgtacaacgtgaaacaaagtagtacagttagatgtggcaatgaaggaacggtttctcagaacatgatccaacaatttgcttaatgcgacttccgagaaaagtaaaagggaaggacaagttgaaaattttatttgaggggtggaaattggaaaatatatttaattatttatttcttcttccgacaaccatgacaacagttatactgtgtggtagttgtgtcaaaaagaggacaataaataaggatatagtatttttggttttcattatttagatgagtgaaaatacagaagaaaagaaaatttggaggtgggacgcagagtttaaataaaacaagaacaaaatcacccaacatgcgtgaattgagaggggaggtggctgaattattcattagtgtttaaaaattaaataattttctattgatttcttttatgaacaatatttttctattcatttaaacagtaaatttttactttatttctatctatgttattcctatcatatctttctctcttaatttactcgtttcaaaattcaaacacagcgtgaagaaaacaaaagaaaaaggaatttatctatagagttgtcattgtagaagggagagacgggtcccactggccactaacatgcccaaatatgaaatatcctctgcatttccctttcgttttgcctcactcgttttttttcaatctttctctataaggataaaacttagatgatttttaattttctataaatgttttaagtgatggaattcattaatatcaaccaactggtgagattggaataaatatacgagaatatatattaaaaaatgttttgagtgtggctttcaaattataattagagttttctaataatttatatataccttttaataaaatatttattacataagtttttttttatggaaaacttaagatatttaattcataatcaaagatcgaatacaaaaaaggagcataatcaaagacttgttagggcttcacaattttttgcttgtattacataagttattgaaatgaaattttaatttaattaaagaatagtctatataaaaatatctacaaaattgtattcaagttttttgttttatttataattcatgattacgtgatcgttacttttttcatgccccttttcataatatatgattgattttgcggaatttttttttttcttaatagtatattttaaaactcatcaaatttaagactacttactcaagagactcattaaataatatattcttgttttctttatatatatcttcgtttatgtcggctaagttgagttgagcttccatgaggtgcacataacagatcatgtatgatgcaacgactcgctggttctatatagttggcctatttaaaattaaaataatattgattaagatgacatcactttgaagagctatgtgatattgattatgttggtgcctttatctgattagctgcttcataatattattgttaaattactattataacaaatatctagctatagtttaagtatcacactgttatttcaatttggaggagcttgataagagaaccaacttgatgtggccattgcccaatgcccatatagaatgccattggtatttattggatgataaatcaaatgtatatgacatacaattatatttgtaaaagagagtcaataggatctaactcatttgatgtagattgtgcgagttattgtagtttttctatattatttttaattcttacaaataaacaaaatatttgtacaagagaggtgagcacttaagagctaagtaacacataaccgaagattaataacaacaaagctacaactaacatgttgacaatcacacaaacactattactctgtattttatttttctttcaaatcaggtgaattagctcatgaatccacttgacatctgttcaagaaaataaaaattatttttgtcctattcttcttaaacaaatttctctctcactttttttgatccaccttggtaagcgaattcaaactatgatttatgctcagtttgacctaaaatatgtagatgtcatccatgattaagtacaacaatattaacaaaataacttctgtttgcttcattttgtgttgagctttaggttggtctaatatgcccctccttagtcaaactactaataaaaaatgacaatcaagttgtttccgtttgaatgagtgaattaattagaaggtgaagattttataattacttgaattacaatacccccactaaatttggtcattcacacggtatggaagacatagctgaagaaccgttcttctccttgtaattgcctttcctagtaggtagttgagcaaaagataaaccaaaatcaaactgaataattccgtcgcaaaccatggagttgccctggtgattgatgctaatttttaggtaagatttttaagtatttctagtattattttacaattaaatttggaattttatactagcaattagcatcaatcattaattttaatcttcatttcataaaagtatttgtgatactgcacataaattttactattgattaattcttaaaaatgatctcagttaacattttttttaatagtaaaacaaattttattagtaaggatcaaaaaagtataaatgtaggcagacccttgcacggttgcaccaagatacaatacatgagttgtttgacatgcaaccggacctacaatacccaaattaatgcaaaacacattatgctatcactttacaattccaaaacggcgaaccattgtattatgcttgaatccaacattttacgttcctcattcacgcgacttcaaccttttcctagaaagcatcaatctttcatttgcagttttgcgccaaccacatgcaattttcattataaatgtcacatattcctcatttacctgtttcacacttcttgcattctgcatctttatacaccccacattgatataaaaaaactatatatggtgcacatacaaccaatacactcattccattctacgttccttgcacaccatgcatcatcatatctacgacttgccttccatacccactcacccccgtaacgcccacctacccatttgtatctacctcaaaagaccccttcatttttttggcacacccttgttaacttgtgtctcctaaacaaaccaaaggatttataagagtcactgaataaacaaaccttccccctctgagcctaatgtaggtttttttttttctttcaaaaacaaccaaactctctccttctccttctccctctaaggaaactccaagatataatatgtatggtttttttctcaaacgttatagaattatttgtctctcatatttccacaccacaacaaagcatgctgtcctaaccttctcattcactagtgagcctttatgatctcatgacataaatgttatttaaaggatagagtaaaataatactatttttgcgtttaaaacaaatatttataactcattattagtattgatttttccttaatttaagatgtgatatgaaagattaacaaaataaaaacagtcaaaaaacaccttttcccatatatcctcgacatttattatatgataatcaatgaaggttctgaatcttatatctcatttaaaaatcaaacacttgaatttctgtagttaaggcattattttaaagttttataactcggatcaacttgggcagtccgtccaccacaaggtcgagtatgttgctctatctagcgagcatacttttcacttttattgatattttttataaaataataaaatctatttcaaaatgtaaaatgattttttaaattcaatattttaaactaattccattttttataaaattattttaaattaattactttacactagggacgaatccaaaaatagataagtgaattgacaagtaaataaatgttttttccatcagatttcaagaagtaaaaaataaaaaaatattagaaaaatattttttatatataaaaaatagaaaatttattcaatatttattttatatggtaatttaaatatttaatatcatatattaataatttcgcataatgtattattgaaaacataataaacaatttcttaaataaatactatgtattttatgtataaaaaaaaaagtatcattaagtagtttaaccaatacttgtaaacaacaagtggttaaaacttctcttaaaactaacttaaaaaataaagtaaggtcattggaaggaggcaactaagtaaagaaacacaacattaaattaaattaaaaacacccacatattattcatgcttcaatttcatttttccttctcctctcaattagatattgtcaatattatatatataccatgtgccataaaccctcccgcaccaccaacattgaccaaaataaagtaaggtcttgccatgaacaacaattcctttgggttttctgtttttctggattgattttaattttgatgggtacaagaatggctagctcatctgaatattgggtatttttcggccccaagcgaagtcactagatttaaaatcagccttggaattgtccataatgttttgtactaatgtgagttgttttggataattttcttgtcaagattgaaatgatgcaggtgaagagttcacatgtattgcttaaattatgtggatgttatgtgtcgagttcgaggttaatgattttgatgcatgtggatgtcgtagggattggtactggtaatgaacatgctagagttgatcgaagaatttgtgttgcttatattcattgtagcagacattctattttactatcagaaatatggcttccatgaaatgcagtaagataaaaaaaatacataaaggaaaaaggttcaaataccttaccctaaggatgactagcacagcccaaacaaattataccaatttaattttatttctcaatcaaccctaaattaattgaaatttattctgttagaacttataaggggtcaattcgtgagatcttttgtttgagaaaaaaaaaaatatctcgaccgataatacaaaatgagaagataaaaaaaaataggtgttttgcctttggatatgagtcataaccatccatatgaagctttatcctgatatgcttctccatgttcttatatttcatgctagtctttattgagaaacacttatgagacttgctttccctttattaagaatttgtacattcattttgtgcattaaattcaactatgatgtgcatcaaactcttttttcccgttttgcataaagagattgctctttgcacaacctcaaaattttaacagtgaattttgctagtttgacattcatggggatattgatccactttttaaggtaaagttatggaagttattccacattcctttgatacttttcatctcttaatttaacccaactaaattttttatgggataggattaatgatgtgaactgaacaattaggtatcttggtattatagtcacacttgctgaatgtcagaaactcataaattttgcttgtttgcatttagcttaacttgctactatgctatatgggtttcagagatgtgttttgtaacgcctggattcatatctctattatatttatttctttgttctattcaggagtacttgtgaagaagttgcatcccaataatgtatgtgaaaaggtttacatgcaatctcctttttgtgagtctttaataagaaagggaaaacttagaaagcaataattagttcttacaaagcagcataagactgctcttatacaggacgtggactccgttggcgagagaatccactatggttgtcttggtttcctacctaataaacgacagataaagttatttctttttaatgttaatgtcactatatgtttgtttttagttttgaacattttgttttcctttttttttnnnnnnnnnnnnnnnnnnnnnnnnnnnnnnnnnnnnntttttttgaaaaactacttttttccctgtgttaatatgcttttggaaaggcttttggcttttagtagataacttgtctttcattaggtaattgatgttgaatggtggatcggacaaacccaacaatcatggagtatatcatacatgtgttaatttcaatattgacgttaaataatataaaaaaaaaattcataaataagcgagatgttaaataataaaaataaaaattaaataaacaattattgaaaataagttattaatggatggattttcgacgaatatttcattcgaaaattacaaacgtattaatccgttgaaaattcatgacggaaaaatctgtcggtaatttccgacttaacgtaccaaccgaaatatccgtcggaaattaccgacggacaacaaaattttgttggttaaaatttcctacaagcattttctcgacaaattttaagggttagcaacagatttttgccatcagaaattaatttttttttgtagtgtaaatgagataattttccatttgtgagatgattatagggatctttacctacctagatataatgtgattaggggtggaaacagactaggtcaggccagacttggttaggcctggccttggcctgattgaaaaatataaagtttggcctgacctatttacctgttataggttttttttagacttgacctgacctatttaaaagtctgttgcctacaagcctattaaaaagtttatttttaatagaaaatttaattttacaaaacactttaaatcaatttaagaaagttaaagaaataatttttaaacaaaaaatgtgtcaacatcttacttatattttcaaataagtaataatcattttatgagattttcaaggtgattttttgaagtgattgatcatctattttcataataatgaaaaatatttttagaaaaataaatatattattttttaagttttaatatatatatatatatgtgtgtgtgttaaataggtcagtctgataggtctaacatgtttttttttaaagcttgagctggacttttttagttaaacaaaattttcaaaaagccttagcctaatctttaataaacaagtcaggtcaagccaaaggtccttgataggcgatctggtccatttccatccctaaatgtgatgtaatggtcttgggctccctttaaaaaaattaaaaaaaattaaaaaaatagaaagcaccgcattaaggaaaatgttgatcagtatgcaacaaaggaaatgaaaacctcaaagaaagaatgaatatcatcgtaaagttgattgtcgtaaatcatactattcacttatatttctcgtaagaaactcaacatatctaagctcaattgcaccccaaaaataaaaataaattatactacctcctataagaagaaacacatggttatttccttttatatcttcaatttattatgaagtcaattaatgagttattaacaatatactaacttattctcatttcttgaaaaaatatttcttgaattatgaaagtgtcattatatctaatcaccaaccaattaatcttaaaggaacatctttggaataaaatttaaatttatgtcagtattgattaaaaataactaatttaaccatgttccttgatcttgatgaggtagtattatccaacaactatctcactcatctacttatacaagcaagctatctcactcgtccacttataaaagcaatcattatagtggctctcttgtgtccacatttgtcataattcaaaaagtatcaaattaaatggcttaaaagaaatagtattatgagacattctataatttatcaatacgggagatttttcaatctctttatgatgacaactcgtccatatatgcagatccaataaatgtgtggatcaaatcagactctagctacctcaacattcatttcaagaatatatgtagactacttcaattaaaaaccaaagcagatacactttatattggtagtaagatgaacaactagacaaacaagcataatacaagacgacaaatcataaaacatgaaatccaaccgaaagaagactatgtgcaatcaagtcagatcatcctcctcaagttctttggctttcagcttttctttcaccctcaaaagaagggttgtcttccaagaatcctgcacaacattcatgcaaacatgcaacgttgatcaaataccgcgacgaaagatatttatggaatgcaaatagaaaaattgatcagaagaaggaatctaagttgacaacggttcattactcagttgaatatagttacacaaaaaatagtgatgattatttttcctcaacttcctcctcacaaataaatttgtgatttgattccatttagaagtgtctgacctagattttccaatatgtagaatgtgatgaaaagtagagagagagcaagtttttaactaatattttttcaaggcaaaagaggttagcggaggcaaagcaactctaaacatcaactatgttggtaccgtcaacgctacaaagtcatgaccagcaaaccagtaactcatatgtgcacataacgaatcaatatttcacgggaacattcagagcaaatgcaaattagagaaaataaagattattaaaccgttgtaaatcggagtaaatcaattatgacaagtttattctgctacaagatcttcactatattggaaaaattcttgttatataacaacaacaacaacaaagtcttatctcactatgtcaactaaaaattgtttcatcttacagcaatttagaacttaccaaaggggtcatgctatcaaattccttgataacttcagtaaactttccaacatcttcttcatcaattgcagcagcaatatcctgcccattttttttttttaaatcatcaatacttcagaaataaatgagcaatgaatcagtacgtgcaagaaatttttttttcataaaaccaaacattaataagaacatgatagcagaggagtcagttattgaaatttccaaaactagcaacatactgccagaagtctatattcacgtgttccagaaaatgttggatccaagtcctgcataaacaaaaacatatccaaagaatttagaaactggtgattttaccggtctcaagatgtaaattcttgaaaaatattggacctgatatcgctccaatgcattggtaatagcaataacatcccctttacaaagttggcaaatgccagcattaagaagatgtcctttaaccccatacttcagcaaattattgctgacagactggcgagcaatatcttcataaatctcaattgacctctgatatctggagaattataaaaaaaaaaaaaaaaattgaaacagttaatattcaatttaacatacagagaaggctattataaagtttctttcataacaaattgttttctttacattattctagagttcctgctcaaattgaaaccaccatacacatcaatgtaaagaaaaccatgtatacatgtcaatagcaaatggactaatttttgttaaaaccatgtatacatatcaatagcaaattcttaaacttgagcagatgttaggggggaaaaaagataccaaaccatgatagcgggtgacgtagaggaaggccaacatactaaacaaaaaaaaaacttagtaaccaacaaacatagaacaatagaagaaagccatgctcaataaggccttcacagttcacgtcaacaaacaagatcaaaacaagcagaaaaatagaaagtcttactgttctagctgggcagagaattgagcaactttttgcttgcactggtttgcagaagtgttcacttcttcattttcataaaaatcagctgatttttcatagtaaacaacggcctgctcgatattctgttcagactcatacaactcagcaatttcctgcacataaaaaaagaaaaatccaatccaatcatgatacattcacgagaattcctggaagaatgcctcaaaaaggatagccaagtggaaaaggacaccattttataaccaaatatgcattagccacactaaaataaagaaattataagctatataccttcaaatatctagcagccatagagagtcttccaatctcacagaagatatttacagcattatctaagcaagatacggactctgcatcgaaaagagagagaaatagaaccttaacatcgaacttcgattaagtgatggcacgcattatataatttgatcacgcgcaaaagcatatatgaatttgaccacaaacatacacacagaaaaatatgttcaattgttcaaaaatcataatcctaatgtatgtaaattgtaaccacatacataccatttatattagtttttttatagcaatgcgcagcgtcaacataagcttgtgcagcttcatgcttgctttccaactacaacaacacgattcatcacaacaggcatagataatcaaatcaaagaacacaaagtaaataaaataaaaatccagaagttagttagttagttaccttcaaattgcaattcgctaatttgatgtaggtggatcctgctttgtcccctgaaaatgtgaacaaattcccgtgacaaccttaaccaacgattaaataaaagacgcaaaattaaggttacatgatttagcgagcttgtaagaattggcggatttgtcgaagagatcagcagcgtcctcgaatttggagccaaacaagccccaaccgctgagcttcttctctgccttgttctcaaaatcctcggccctcgccaaatgatcacccatattgtaatgaatcaatcgatcaattcaattccctctnnnnnnnnnnnnnnnnnttttttttttttttttttttgagacagagataataatgtcacagatagaaactattcatcaccaaattggaatgaaaatgaaaagctatgtgcgtgcacaacaaaaaggctctatttctgtttcacacgtcaattcctcccattcagaatattctttcccctgggtacgttcgttcggccatttcattgggctaggcccatttagtaacctagaaaacactgagttcaacttcatgtctaaaacctctatttaaaaaaataattacagagtgcttatttaaattatcaataaaattaagcaataaatgattaatatattcatattaatattgaattatttggatactattcaagttttaaatttacttatcttccgacagaacttcagattattcgatatctctttttccttattaactaaagaggattaaaactaaaaaatatcaataaaattaattacattaaatcatatttgtaattttaatatttatgattaatgaattaattcaaacattgaaattaaaattaattttttattacatattatgtgtacgaaatattctttgattttgactatgatcaatttttagtgaaaaatctaattaattatctttgagatttttctacaattaagttttttactcacaatactcatattcgagaacttaaaaaattcgagtccaactttagttaaactagaaatgttaacaattgaataaaatgtactcatagtaaaataattccttttatttatttaatcgtaacttatcattagtgattagatttttaaattttatgataattaactaattattatattgaaaatcatatttaaagcagtttttaattgactgaaaatataataaaaaactttacattaataattataattaattatataaaaaaaatcttataattaattatagttaataatttaaatttatgacaaatatagaaaacctatccttcccccttacggtccataacgattatccattgcattcattacaaacctattctcattaattttgatttttgaagggcatatttgggaaatttgaattgagtgagtggattaagatatgaatcagcaagtcgatccaattcccaggataaagactaggtatctcaaaggctggttccagatggtgaagatgacaattacacgtcatagacgatttcgaattgcaatattttccttgagacacagagaataatacacgtggacagagaattatgcatggacatttgccgagtataaaattccaatttttttttaggaaaataaatgtttgtgccacctagtagataatgtctttttagaacaaaagtttatttctcaataaagctaaacgaaattattaactacttcaaattatttatttgatttgataagaaatcgtgaataaagaaaaaaaatattttccttgcagatcacaagtaactagaataaaaaatcgaataatttattttgatcaaagtataattcttaatctcgtgtattaaaaaagattttattaaaagaagtatattttattgagttttcattgtaaaaatagttttagaatgtcagtgtattactattaaattttttaaagaattgatttgagtatggagtaagttaaaaagaattatttatttttattttttactcaagttttgtattctttttttttattagttttttgtatttttaattaaaaacagaaaatatcaatcacaaaaattagtgttaatcgggatacttttggtcgggaattatatgggtttgcaggttctattagacacccgacatcacttttgtggagttgatggttatttttagggggttgcaaatagtttggaattataagaaatcaaatagtttattaagactcagtttatactctatccttaatcaatgaggacaatagaagtcacaagtatgctgtcatcatagaaaaaagaaaatacaattcaagatatgaagaatcttgattgagttgttcaccttgtccatactaatttgttggagggtaatttttgtgtgccttttctggctaagaagagcacttcacaaaatgttgaacttgtacgttatggagctctcccacacacacttgatgttcttccatacctttacgcaaatattatgttcatattatttgtgtgtagtcttttgttctttttattttcctaatgtaccaaaaaagaatcatgaaaattaattttttatagtaacttaaaaaaaatcaattagtgtgagagatagaaaaataaaagttcctatcatatagatttcattatgaataggatatagtgaatgagtttgggttgagtttgataaaatttatgatctaatccaatcaaaatagaataaattgttttagatcaattttttaagaaaaaaaattaaaaacctcaattcatttgtaaacggtttgaattagattgtcttaacagatcaaaatatttaaatttatcttttattaaaaaattaatatttttataagctatttttttaaataaaatattaaatacattatttataattgtaacatgtagtcaaataatgaaagaaaatatcaatggaggaatcacattgtagttattatcatcatcatatagactaacatattatgttaaacataatttaaaaaaattgaaatataataaacaatttcaagcaccacacccatgaagtctaaattaacaatccaaaagctaaaactattatggcataatttgaaaatttcaatgttttgaaatagtcaaatgactatttgtagttgaaacttcaattaaatctaaaataatttgaaacaaattaaaaaacgaaatagatattctacaaattgagaatttaaacctaattttgttagagactaaacttttaattgttaagtctgatattaacaataattgatttttaaaattaaaaaaatatattatataataataataacaatatacaaaggtaagaatgcatattataataaaaaaagatatttttctctcccttatatttgcataacgagaaacttatcaataatgagtttgatcaacggatttaaatattaaaacctatgacttaacctaaaattcaatggatttgaatgcattgagttaggcttgaccctaatgcaaaaaatattcaatccaaattgtttagattgatttgggtaaatttaaatttgcagatgatatatatccataaacacaattataaattagaataattagttaaggcattagtaaaaaataagtttataaaagattttttataatttagtttatacatatatgttaattttaatttacagataaacttatttttatgttatgttatttttatttttttttattttcttctcttatacttccgtaaaaaaatatttatgaaaaattattttaataaattaatcctaaatcttaactaatttcatgttatttaagaagtgatattcggagttccttttatttgattcagatttgatttccaatatcacatttgattatctcatttgattcatgagaattgagatattaacaaaatgattctcaaaatagaaaaaaaatataaatgaaatctcattcgtatatattttaaaatgaattagttttttccataagaaatgattgattaaaaaaaaaaaaaactagctgagaaaggataaaaaccacatggacatgggcttgtctccatccactccacaacattcatgattcatcaacgacacgacacccaacatgaagctagaagaatccatgtccaactcccacatcactgccccgctccttccaccgaaagatcccagtccgagtctgcaaaatggatcaatctccggagcggtgttcaacataacaaccaccatgatcggtgccggaatcatgtccattccggcgaccatgaaggttttaggcatagttccggggttggtggtgatcgtgttggtggcactgataacagatgtgactgtggagtttatgctaaggtacacaagttccggtaaatcctccacttacgcgggcatgatggccgagtcctttggctccataggatccctcgcagttaagatttgcgtcatcataaccaatttgggggtccttatcatctatttcattattcttggtacgtaagttcatctcaccatcaattccttctctctatattgttttatctcatgttcatcagtaagttaagtttacttgcaactcaaatttttcttattttggtaggattaatttttgtatacaaattaaactgtccgaaaatgttttttttttttttttacgtattaccctacagttagtaagagagagagggagataaaaacaagaaaaatataaagatgataagtgaaatgatataatagggtgagaactaaaaaaatggtaatgaagtgttggaagttttgtagtgttaaaatgtccttactttttttagtttttttttatgacacttattcgtatttttggtgactttattcttgataagtgaatatccatggtttggtggggccacgttctgtttggttcagctacccattaattattattttttccttcctaaaccaataatttgtttgtaactataggagtaggtttaacaaaattatataatgcgcattatatacaataaataattattaaaatacccattttaaaatttagtaggatggattaatatgcatttacgtcttttaataatacattatgtgttctgtatgttggggtaaaaatataagaaatgttcatcacacactttctatttcactcttctaaatatattctcatttattaactaaatttattagaaataataaatatgtgaatctcattcttcatttttgttttatttttgtgtacaatgatgacaataagaatcctgcatctatttaatccctaccattaaatcgttcctagtaggttcactcttcatttaatacattctttttttttttttttaggaaatttaatacattcttactcatactttatatttttttataaaaaaattaaccaataataaaaaagtatgtaagaaaaaaaacttgttagttatcttttttatggtatacaatagtgacaaattaacaatgaggatgggtctaagttttcatagattttgcctgaaccacaccactaagctggcctaatgggttctcgctagccatactaaaataaacatttgaacaatggtcttggccataacaatcttcccttcaatgcaccgcctgtggcacaagtccacaaaaaagtttagtgaggaaggcgtcttgatcacctttaggtttcttaacccaagttacatcaccacccattattaatttgtgttagtttggtcaccaaaacaccttgaatgagattggggcaaaactttttcagctccacaaatcaattatgtgagttacaaggatcatgatcacaaccaaggttttaatatgtgatgccagttttgttgcgatctttgaaattgtgaaactgcatagttgatatggccgtaatttcagttgtgatcgcttcaaacaccttatcattacagccaaaatcagaaccttttcttagaatgttgatcagaattaacaactatgtgtggaaatgctaactgcattaacgatagtgatgttactagggaattcagggagcagttggaggaatggtggcatcaaaattaattaggaaatttcaagggtaggttgatttcatgaactatatagatacttcgaatgtcataatgtttgtacctttaccagacaactttatggacttacattttctaactattccttgtctatgatatatatataaatttgactgggttcattggctttgttatggaaggagacgtgctctgtggaaatgagtcgaacggtatcacacacttgggtattctacaagaatggtttggcatcaactggtggacctctcgtgcttttgctcttctttttgttgcactcttcataatgcttccacttgttatgttacgtcgtgttggtcagtattactactatacccaaatgcacaagcaatttttcttttcttggcaaattaaacgtagcctttcatcttaggaacaattggctaattaagcacagtttatatattgttttcaatgttttatatgtacagattcactgaggtatagttctgcaatatcaatcctactagcattggtgtttgttgtaatatgctcatcaatggcggttagtgcattgttgtctggaaaaactcagacactgagaatagtacctgatttctctcaagtcactgtccttgaccttttcaccaccatcccagtgtttgtcacgggttttggattccatgtcaatggttagtttcaacattttataacttccaacttaattatatcatcttttactttttcttttaatttgtcatttttcaagaaaaaaatctatttatacgtatatgttactattatttagatagtactgtattaactaattattgatttgttaattataatatcataaaaaagaagacactagtgtttaaaatgttaaagtaataaatgggagaaataatgaacgtatgaggaagttataaataaatattaatataaatgaggagattaattatttatgtatatattataatcttcgaggactcataaaaaacagagaaaggattatttaacatcaattaattaacttattaatcccaataaatatcattttattcagttaaaaacgatggataaattatattttattcatttatttttatatgttctcaacttatatctctatttatttaatcactaaattataggatgcttgggttagagttaaaaatgttaatttttgttactttaatttagtattattaacactttaaattgtgattatatatttttcactttaacccgaatttagtgaacaaaaagtttataaagataagctaagagaatgtgaaattaaaagggtgtcaagaataaatcatccaataatttataataaaacacgcatctttgttttgttttgttttttttaattcagttagcaaataaaagtggtggaaaagtgtaaaaggtgtgaatggcaaagtttctattgtactatgattaacttaattacccatgacttggtgcagttcatccaattagagcagagcttataaaagttgcacacatgggtttggctgcacggatttcgttgataatttgcgtggctatttactttgctattggtttctttgggtaccttttatttggggactccatcatgccagatgtgctggtgaactttgaccaaaactcccatacaagtgctggtcgattactcaatgccattgttcggttaagttatgcactccatcttgcacttgtgttcccaatcatgaactattccttgagggccaacatagatgaactaattttctcaaacaaaaataagcctccccttgcatcagacaccccaagatttgtgtcactcactttgactttgctaggcctcacatacttggtcgctgtagccatcccaaacatatggtatttttttcagttcttgggatccacaaccattgtttgcacctcattcatcttccctgctgcaattgttctaaggtatactactaccaattaatttatatatactattatgcttaatttatatataaataattaatttacatcccattcctctcctcttctgagcacagggacatgcatggtatatcaaagacaaaagatcaagtgatggcaatagtggtgattgttttggctgtagggacaagcggaattgctatatggaccaacttgaatggttcaggggctgatcaatgattaaccatgatgatgttatataatacccagtcttctcaagttttagggaagcctaatcaaagatttaaactgagttagatcttctacagttgtgagaatagctgcatcagtctggtccttaatttgattaatttattaaatgataaatttatctttcaaaaattaatttaataaaaatttaaaggtgagattgagaattgcacgtcttgtatttgattcaaacacgagtctgcttctaaggttataggtcctttccttaccacttgatccaaaccatcctaaattcgatctctttttcttccttttacttgttatatattatgttttaattttgttcaattattttctagaacaaccttttaggaaaataaaatgacacgtttgaataaatgagtaaatggggataaaaatgtaagttggaatacgtcatacaaactttttgaaatgagctcaattttgagcatttcagtttttattgaaagattgtctaaattctaaaaatactttttttttacaaataagaaagctaggatgatcagagaatgcaatttgataatgaaaagaccatgacatgacaatgcaatttgataatgaatttgacaggctcaatgcaaatgtaactcaaaaactttgataatctaattcatgtcattcgactctgaactccacaaaatcatatctttggagaggttgaagatcttcttacgaaatcattgtcgttgtataacaaggaagatagaagaaaggagtgtgagctaagtagcaatggcaaaagagtgtttttttttttttttttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttttttaaataaaaacactaattaaaaaagtaaaagaaaaaaattgttggaagacaaaaaaatgcactcccacatgattttttaataaaatcttatttcttttaattatttaaccagttagggaaatgattagctcttatattaattcttaagatgttacttccttggccctcctatttataagatcttttttagaaaatcatttatctctttaacaagatcctttttttttaattttcagaagcattaattatttttctccttaaagtatctttaattaattattctcttttcaaatattaactaattagatgagaaataattaaatagagagagaaagttaatttttaaaaaaataatacttttgaaaaaataataaattattaataaattaaacatgatttaattatttttttaaaaagtatgaatgaatcgaaaaaatcttattttaaataagaacagagaggtagtattatcacgttttcaaaagaaaaagaaaatgaaagttattattatcactctatttttaagcttaattaatattgtctgtatttttattacgttattgattgatttcaaatgcaggagtgatgaccaattagagaaaaggtgcatgagattcactataatccacttccccgtccaagttcattttggttttggtgtccacattctacacgcttctcaccattcattctccaacctgtcactcataatatataacagctgccacaagtcccacttcaatttataatcttacccttcactcttctccccaatacacctccacgtaatccattcaccaacggcattatggtaatccactaaccttaatcattgtaattcactccattttagatatccaaactaaattatattcttaatgtattgtatgtatttttcttaaattacacttaatatttcttttattttatatattatttttacttttttatgttaaaattattaattaattttaattgaaatatttgaactgacgaaattgttcattaaaataaattatacatgtgtttcttgtatttttttttatttttaattatataaaataccccttcttttttatttaatatgttattggtcttgatgtacacaccaaaattgttaatatcaatgcgttcaagaaaccagatgtagcagttatagtgatcgacactatgacaggtacgatggagactttggctatgctggtagtggttgttcctgtgggagtgagtgcgtttggacgtagtgtttgtgggtgaagacgatgatgaggagaaatagatgatgtttggtggtagggtaagtgaagatgagttgttgaagaagaggagaatttataaaattcaaaatatgattttgaaaacgaagataaacatattttagatataaattttcattaaaaatcatatgatcaatatgtgattattaggaaagaggagtatggtgtaatgtgaactaaacaattataagaaaatttttgtagagggaataaaagggctatcaaatacaattacaaaaaaacaaaaaaaaatgtaagttattctagataatattacatccaattttatatatagaaaataaaaattaatactttttcaaatataagaagaatcttattatttaatattattaggatattggttaaagaaattaagagaaaaaatagtaatcgtgaatatcataaatataaaaaaagttataataacataattatatattttaataaattattttttaatttttaatcaatattttaaaaatattagttaatatttatcttataaaaaattaatttactattaaattttattttatttttaatggttactctttttccatgtaaatgaatgtatatattaaattatcaccaaaataaattacttttatagttttattaattaaaaaattatcttttaaatattttacattatttaatgtgaagtgtaattttagaataaaaataaaatttatgataagctaaatttatatatttttattaattttaataaattaagtaattgtttctttatatatatatatatatatatatatatatatatatatatatatatatatatatatatcccggaggtaatactaatatagtatgcaacaactttagtttcggttttcacttttcatactcactcaccgccgggatgtcgccggtgccccgagcacacgcccctctcctcccgggatccaacgatgttcctccggcaactgtgtccggcgccgtgttcaatgtcgccaccagcataatcggcgccggaataatgtctcttccggctactctcaaggtcctcggcgtgattccggcgttggtgctgattctagtgattgcgtttcttgccgaactatcggtggagttcctcttgaggttcacgcgtgccggcgaaacgacgacgtatgccggcgtcatgagagaagcctttggtcccttgggaggagtggcagctcaagtcgctgttgtaatcaccaatctcgggtgtttaattatgtacctaattattattggtaagcaaatattagttacttagattcattatgaacttaatttttgttacttggactaattatgagcttatgctaattatttaatgtgttgtgtcatgtgtgttatttgatgcaatggacagcggatgttttttctgggaatcaacgtgaaggggaagtacacttgggtattttgcaacagtggtttggggttcactggtggaattcacgggaatttgctctgttcgttgtcttgttctttattttgcttcctttggtcttgtaccgtcgcgtaggtcagtgcccactacatttatgtttgatattccgtatttgggttttgtctttaatttgatcctattccagggaaattaatgtttagatggtgttcatggtagtcaatttttatattatgatgacatcggcaaattaaatcattaacgttcaatctcaagtccacagacattgttaggatatcatgtattcgaattattgtccgtttagatgtccgatcgacactcacaattttgtgctagtaaagtgatttgggactctgggctaccggaacacttaatatttagttatttgccttacaagtttggttagatgcacttacttaagtgtttctactttctggtcttgttctataatcagaattgaagtttcacttggatcatttgcaaaataaaagtttgtattaaagatcaagataggttactagatgaaacttcatttctaatgggagaatagcatgttacaagttttgtatttttggttattgatatgagatgtgcatagtcaggactaacatatttattttattgtgccatgctatgctattgtttgctgtttttagagtccttgaagttcagttctgcagtatcaactcttcttgctgtggcatttgttacaatatgtaccgtgttggcaatagtggctattgtagaaggaagaacacaatctcctagactggttcctcgtttggaccaacatacctctttctttgatctgtttactgcagttccagtcatagtcacagcctacacatttcattttaatggtacctaattacttaccttccattttgttacaatattacacctcctttgaactttaaagaacctaaagattttttattgctgataattgttttaatttacttgcagtacatccaattgggtttgagcttgccaagccatcagaaatggcaacagcggttcgaatagcattgctgctttgtggtgtcatttacttttcaataggcctatctgggtacctcttgtttggggattcaacacagtctgacattctggtcaattttgaccagaatgctggttctgcacttggttcattgctcaatgttttagtccgtttaagctatgcttttcatgttatgttgactttccctctcctgaatttctccttgagaaccaatgtagatgagttcttcttccccaagaagcctctacttgccacagatagcaagagatttgtgagcctcactctagtgctgcttgtcttaagctacattgctgctattgtagttccagatatttggtacatctttcagttcatgggatcaacatctgcagtgtgccttgcctttgtcttccctggtgctattgttctaaggtaattaatctatatatatctctcatattgagtccttttctcttcatttgaacagttacaattgtcaaatagataaaaaagaatgttaccgacactatctgatattccgtctacgtctaactgaaatttatttaaaatatcaattttggtggttcacatttttcatttgtttaatttcttttgtgaattttcattttttcattaaatgacagggattcttacggtatatcaacaagaagggacaaaattattgcactgtttatggttatactagctgcgataacaagtgtgattgctatctccaccaacatatacaaagcctttcagtagcacctcgtaaatttgtgttttctttttccttttctatttttccccttatatagaaattttggtcaagggggagagagagagagagagagagagagagttgttctagacgcctttgattgttgaggcacttgggtttatacatttggatgccattattgtttgttgtaaaattcgtatatctagaacggagcagctatgtaaaatataaaataccaagcatgcatacaaaatgtgaaattgagatccaaatttagggttgaaagagcatgcatataatatgagatccaaatttaatgttgaaaggtgacaaagtttggccaacattattatttagtattctagaattccaagcgcaagtacaccgcgtgttgacatattggtaggtggtacccattattgagaacagatcctgtagccatacatgtatttatttattgtatgtcttgtcatttggtacatcaattcttttaacaatgtattataccctgtcattttccgcgagaaaatgaagcttaaatgctcaaatgatcacaagccaaattggtctaaaatagcaacttgactacatgtgatcgtttcttgttaggccacggactatgtcccctagttatctatatgtggcgagctgtttgtgtgtattaatggtgtcctctatgcctacgtgtttaaaaaagatagggtgtataaaaaaaatatttttttttttaaaatctttattttttgacaatttaaaaatctttatttgaaaatagtgttctgataagttaatttttgtaatttattattaattgtttgataaattgaaagacataaaatactgaaattgaaacagaaaaaatatttaagagaaaaaagttttatttgaaagacacaatatgatggttagttattcaattgaatttaaatatttttatatcaatttctaaatattgtatagatgtacttttttttcttttttaaaaaaaattaaatatttaaaaaatattttacaaaaatcaaaataaatccgctacgatggatctagtggtggaggattaagtagtatgtacaaagttataagttttagctttgtagctatagttttaaaaataataataataattcaaatcgaagtgtgaggtatatcaaatataggtactaataagaaccaaagacacgtccaaatttcgtgaaaaatataaactttttaactaactttgcttggcgcggttgcaacctcagactagggcatatcatcttcactaggggtgctttgattttgcaatgcttgtaagattagaagtcaaaacaggggaataaatcgtattacaagataaagaatgattttatattgtttggctaagagttgtttaaaacatttgtcacagttttaaaatttattatttccctagtgtatacctagtaacctagactatatctgtgggcagtcaaaaaccgaagccgagagagctcgagaccttgaagctatgtttggatacccggaagaggatgaaatataattgtattatgttttattgtttgaattgataaaatgaaaatgaaatataatgaaaactattccattatttacctttattttttccccacaatttaaaaataataaaaaaggattgagaattttattgcatttcatcataataggtttatacaatgcaattagttattttattctattatatgttatgtcctttatggcgtttttaatagtataaccttacccaggagggagatcaatattatatgtaatcatttacggtgagtattacaagcaacacaacaatgaaagcataatccacccctgcattcattttgaccttaaagctttctgtccaattgctgaagttgctccttggatatacatcaattagctgcaaatatgttgtaatttaatttcgtcagtttgtagtgtaaaaagccttatttaggggaaaatcagtgtatttcccctttatatatatatatatatatatatatatatatatatatatatatatgatctaggtttagtcatgtattagagtcaatttaaataattttttaatatgcatatttatataaattttattgatttgcaaccaaatgcaaaggtgatgtagtattcttaagcaaaaccttaagccagttgttgacatttaccttaaaaatgttatgcaaattaagctcaagattaaaatctgctcagttagtaattctataaccacatacctctgcaatcatggtgtctcctttgtaaactttgcaggacttgtcaatgtggctcccaacaagttgaaagctgctgatatcttcattgatgttggtggccatgaacacatcaagccgcggtttcatgtcaagagggtgggatcgttgaaccccaaaaatcagatccttctcctccgagcttttgcctctatgaaccatccaccgatgccgcagtgtgatcagcttaaccttcaatgtgtcatcacactgttaatttcttattctagtgtatgtatattaattttatatatcacttaaaaattaaaccattggcaacatgggttaaggttatacaacgtttaataaaatatcacaaaaaagcttattaataacatttatttattaaaaaaataataatatttttactaagtattaattagaaaaaaatattattaaaaatcacattgtgtaatagtaactatacattaattgccaggcaatagattttataacattcacttaaacagaattatgaaagaatattggtgcttttatttgcttcatgtacgtatatagatattgatactcttgtttaattatttcacagaatatatgtgaagtatccaagtccttagacataatctcaaaaaagaaatgagattgatactattttaaaatagaaagtgatttacaataaagataatctgaaaaaaggaatcagattgatactattttaaaatgggaagtgatttacaatgacgatggtatatatgtttgaagagtgtttctgacatcttctttttatgattgattgaatttattaaaaattatcaattttgatagattttattttttatttataaattaggagataaaaacattaattgaaaaattaaacttatcaaaattaattattttcgataaattttaatcaatcacaaaaatatattcaaaagaaagtgtagatagagagtgtcgctaggacaatgtccaaagaagtataattcttaatttagaagcagaattttcatacatgcatgcatcgattcctatatatttttaaaataatggtatcagatgataatacttgtatctatgcattatatatagaggttaggagaggagtttatatactttctcacgcattgtaagtataggggaaccagcagcatcacgcatgactctcttcttgcgcacgtcaaggcttgagccatcaacttgaagcaagagatcaccgttaacatctaacacctcgtatcgttggtttaagaagaatccgcggtaattcttcttcacagttatttctgttgggtaagtcacacagaagctatcctctacaacactgatcatggggaacccatgtgccacttccattggcaattctggagcactggcctccattaaaaaaatagtgcctcaaagaattaacttcagaaataagagtttatggaaagaagctcaattaattttgcttaggattttgttgtttgtaagtgcagaaaacgtacgctttatatatgagagctgaagttgttctttcacgttttggtctccttgaattatcagaacatgtagaaaagcaagataggggaccattcttttacataattaatttcatcaagtgcttgttatttattaccaaatcaaagaacttgtgtttttttttatattatttctattaggaagcctgcttagtcattgttaatttcagaagttcaaaatgactacttttcgtatttcttagtcagctcttagacctgaagatagatatataaagagtaaaataaaatttctagaaaaattatttgttgaaatctttattgaaacacgtaatttgctgaaaactttttgtagaatttctttgcctccggatttgattgtagaataagaatgaataatggagagagagagagagagagagaaaaaaaagcaccactttattacccttgtacgttttagactttttgagacaatgaatatacataaatatgattttttttatagatataaatatgggttaaaattttaatgtaatatataaaacgagaaatgatacacaaatcattttttaattttaaatatctcaccaataatttttatttatttctctttctgtaacgttacaaatcttatcatatttatatttttatcttattttatttctttttctagttgttaataaattaataggtgtccatcaaacatttttcatataaaatcattcaaagaagaaagtcaacaagaagttatagtagccgtaaatatgtatattttacaggcaatctggtgaatgttctaaggatgataaagaatgatgatgaatgagtacaacggagcactttttccctgtgcttttcaatccttatcttcacctcaagatctagccctgtcaaattagataagttcaatcacaccaataagaaggaaaagtagccaagccattctgttgaaaatttcaggctatacagtatttttctatatataccaaaaaacaaagcaggaacattagaattaccgaaaatctagcagtctgagaggcagcaaaagaaatcttttcgatgggttgagtgctgatattatccctccatttctttctatccttttgccatctttaccattctcttacctcaatggccatgcttcagtgcaactgtttctcgaattcaaagacaacggttttcagcaactacacggtatactatgtagaggtacgaggttacgtacataatacagaggagaaccatgttgccgggctctactacatgggcctcagaataataagcccatcataaaatgattgaccggcctgattggtccttcttcagaatagacataagacgccctgttcacttcaactgtaaaagtgccactcgagttacattagtagcctaattatcacaagaaaataatggtaaaatgtgttttttttcaaaaaaaaaaaaaattaaaatgttaggatttcattcttgcaaaaaaaattagtatatttttttgtcttcaaaaaattaaactataacaaattttaattcagaattaggttatatatctaaacttatatcttgtaatttgtgacgattttttttttttttgcaatttaagactataggaattttttgattaaaaactttaataaatgtaaatgaaatgtataatctatttttttcatatataatatgaatctcattttatgaagaatttgtaatcataacttgtatgtatatataagtagtgttatttcaactttgatgtctcccataattctaataagtctttatctcttaactcacctattatttttattattattattattattattattattattattattattattattattattattattatagactagttactattatctttttttatatttttatctactagatataattagtattatctattccatgcaatgcataatgcataatgccggggtgtactactactatagtatatatgtcctgaatctattgtaacctcacactcacctggcactccctatagactcgtggttttcaaattaggagtgatgtccttttcaatatattttttttttatcctcttctctacaaatggttgagttgtgactgttcttcttcccagtaccccatgacttgaacccttgttcctgtgggggctgactgcatcaatcgctaccaaatcacagatatatatgaaaaacacaaataatgtaacaatttctgccactccaaatactatatccgcaaattcacaaatagacacaaacagttgaaaatataaaaatcaaatcaaaaaaaaaaaaaaaatatatatatatatatatatatatatatatatatatatatatatatatatatactgctaaaatgtctctcttcgaaaagacctgataagcacaagtgtttctcgctctctgcccttttgaggcatttcattgtttgctgtggtggattttgcagccttgtgaagaagaagctctcgagttcggacaaacgacacctcacaagtcacaacactgtatatcttgcttaatcattcatgtcttattctcacattttactattatgaatgttttttttatcaaaccatttttttgttattcagatcacattcttctttatatatggcagaagtacctttatacttcaaataataaatctgtcatatgaaaaaaaaaaaaaaactgtaacagtaaatttatttcatctgtatcgaatgttttccactctccaaattcaaaaacaacgtggaagagataatttttcttttttggtaatggatactaatgcagcaagtccaacctttgcgggtcaaaagacccaccagatcagattgtttcctataatgaaaagaatgaaggtgctggtcagatcgacgaacaagtcatgtttctccaaaggtattattgttctatcaatattcaaattagtatatgaactggtgtctatagaagagtgataataagtagcaagagaatctccatgatgatgtaggagactatttttatagaaatcaaataaatatgaatgagtcacaacctacctacaagctgtagcatcaaaatgcagagataagaatggctagcgcttctcatatggtgtactatattggatgcatttaacttattcacttttggtcctataattttaagattgtataattttagtccaaattttattgtatatttgatcttctaaatttctaaaatttgacaatttagtttattgttagtgtatcataaacttgtttaacaaaaattgctgatataacactaacacgttaacataaaaaatagcatgacagtctaacaaatatatgatttttttttttggtaaacgtctaacaaatatatgatactattacttaatgtgacaataactgttcaaattgtataattgtaatattgtcagcatactattatttagtattatattgatatatgtattaatctgttaggttatttgtcatgttaaaatataagtgtcacatcatttgtaatgtgacatttaagtaattttatttaaaaaatcaacaatagtggtgaatcaaaaattttaaattttaaaaacataaaaaatcacatgtgcgtggttttaatcctaatttattcgatgttatatagttcttgcttcgtatatataatcgtattttatcattttacatggcaatgtctttttatttgttgaaacgtctgttaattgcaatttgtctactatagctataaaagagaagaactaatgagccttaattaatttatacaagtaaaaataaaatacaaaacttgacttatttgattaaaatttaaatttgaggcataatgcatttaaaagtataatatttgaactcggattatttgatttgtttacaatttaatgattttttttcttttatcaaatccctttttcaaattttcccctcatgttagttaaggtagtatgcaatagatgttttatataagtaaacttaaagaaaaaagacagcaaacaaatattttttaaacatagaagtgaagtatataatatattattttttctgattggtaaccataatcaatatataattatgtaatatgttattttttatcattttatgtagacatatcacatagttcttaatgtcaaatttataatatttaactttaactcatttacataaatttcacaagtcaagtgtaaataattaataaatttatttatatatatatcatcccaaccctcttcaaaaatgcgatttaacaaatttaattcaagttcattaaaattatgataaagtattttgatactatatattaaatattatatttttaatgaatacattttatgttaatttttaattaaatttttaagaagaatacttaacaaaatcgaattaattattttattatatgttcgcgaaggtgcctttttcctatgttattggagaagcgaccaattgatatataaaatctttccaaacgtaaaggcagtaataacttggaacacagaagagcttttggcagctagccattataacagcagcaatgtgaaaatctgatactaggatcctatcaactttttaaagaaccccatgcattggaatttgcagataaagagaataataataagaaagaagaaaacaaagttgctgatttaatagtgtatattgttattgatgttcgtaggcaacaaaattatggcagagaaaggacaaaatggaatagctgtccataatgcaaagattttatctaattgcagaaattgctctgtactgaatggaacacactcacaacaacaaagcgctatgtagggtgtatctagctagcttatataactatatgtttacttatatgaagaccagtggacagtgacccttttattctccttcagatgaaaagcctgagtctgaatcgttatcatatccaaaaaataaaaatgctaggtttggaaggggaagaaaagcaaaatgcaaggcataagagaggataagaacttgaacattgaacatgataaacaattgggtcatctaagagaaaaaagaaaaatagtatcataattatttttataatgtaaaattaatttatatatgtccttttacttttgaagaggataggtaactttctttttcttctcaaaacttgcgacagacaagttgattttaactttacccgaagttatttttatttcactttcttaattttgtttcttataaataccattagaaaagtttatattaatttattaagttgggataaataatgtgtgttatattttaattactttattttaatgtgaataaatttcaattattcaagaaagcctttttattatatatgtatcttttaacaccgtaccattagcaactaatttttattaataattttagaaatttaaataatgatataaaaattatgtttaaaatcaatagacaatatatcatacaaatattttaaatttcatttcatcttttaaaaatctataaaaagaagctatgtttagttatctttcagagtcgtaatacacattacttacaagagagaaaacacgaaaaatattcagactgaatggctcgatccgtggaataggtcaccttgactaaatcagaaagtattgatcgaggactcatcagttccctcatatttatcaaaaggttattttaatggttcatattcccatgaaaaattaaacatacatgaaactgtttaaaattaacttcaggcttatcgaaagttgttgggagcggtcctacatatgcaagtctcattcgtaattattaattcattatcactaaaatattcctttatattaaaatagactaatataatcttgcagatttcacctcttaaaaaaaataatatgacttttagaaattaaaaaaaaagcataattcaattatctttatatatatatatatatatatatatatatatatgggtgtacacgagtcaagtttgattaaatttgggaaaattttatacttagtcaaaatacttaatttaaattgaattgattggatttatgtatatatttttttaaaacttgaaccaattcaacttgatcaataatgagtttagttacgttaggtatattgaatccaaagttccagattttctttaaaaaataaataataattttttaaaaaatattacaccaataggttaggtcatcaattcaaaggtttaaaaataaaattcattatccaaactaaaaatgatcaaatttgaacagttctaattggatttaaagttgaacaatgactatacttaaatcaatgtgtttggattgggacagatcgagtttaacctattacaatcttacccgaacctgtgaacaaacaccctttgcccccaaactcgttacctcatgtttgtagatacgtacgtatatattcaataaaatgtttggctttcttgtttatattatcttgatagattcttgcattgtggccaatgctacatgattctcttacctgtccatgaacaacaaaaacacttgtctttcaactttataattttaataagttttgtttccattgtcacacattggcatgtgaatgtacttttccaaagtgcaactcacgtgagttttgctatctcgcaagtaacaaaaatcatagcatactaatgtacgatattacaaacgcaaaatagttcaggataagaagagaaaataactagcttacggaaaattaaactcatggatattataattttaataagttttgtttccattgtcacacattggcatgtgaatgtacttttccatatataattacaataataataaaaatagataaatattggcatgcagggataagttaattcattttatccttcggattatatatgcagatctaccgtataggcgtatagccagttagataaaatggaggctctgtgaaatgtgtgaatctgctatcggtttcattttcataaatagagacaaacatttcagattcattttttaaataatttggaatgtcacgagaaacttttctgaattgagcaatagagttctctgcataattggaccctaaaacatgtttctgtttttggtttcattctggtctcatttggtcacatgatattatactaatggacaccaaaacgcgtacaggtcagcaacatatacaatattgacattactcgcattcatcatatcatttactaattttaaataatttacgaaataatagcatcactttaatctatgcaattaagcagcatgatatagtaatcattcggcatattatatacatagttgcatgactccaatcatacaaagagcctaccgtacatatcatattcatcgatcatgaaacatgcgtaagtaaaaacattcaaatccaaattaaacaaaatcttctcagtctccaactttattgcaactaacaactcttccaagtctccaaggacactccagctataaagggcttaggctccactattaacaagaaatatgaagttagagcaggataacgcaacggagtgcatttattttctttcattcttaattaaaaacacagagtacaaattcaatgtgatccgtaaacaaacttaatcaatgataaccacttgtaaatcatctggataagttgttgcaacatataattatgctaaatatttatcagtctttttttggtgatcatgcatgatttccgccattagtattatattcttattcgttttgaatataattgccttagtgtaaagaaaaccctaaatcaataatcttgcccgtgtacctcacctggctcaccaagcaccatgcagtttttgtgcagtttaattggcatcaatattaattacttactcaattattggtttttgaatcaaagccaattaattattttagttgaaatgaaatgctaataattaagggtgtgtgtgtgtatacgttggaaaaatatagaaaaaacgtgaggttagagaacttaatcaggatttgtaaatactcaataatattttaattttaactatttatttaaattatatgattaaggttagtaaatgtttatgaaaaatttgctaatatactagcacttctttttttaaaagtaccttaacaagttataattacgattttcttataatatattaaaagtgaaactagataataaatatcttttatatatatatatatatattaaatgttattataacaagccactgtttatcaagacaaaaaagacttgcctgtataattttgttttttttttgccacatatgtacgatacatttaaatcaaatagatgataatgacctagctagtctcgatcgatcccacgcccaaccaagtcttgttctttattgtcaatttttcaatgatgtgccagtcagtacacatatttacctttgctttttaacttgaacttcaatgtttggaattgactagcataaccttttgttagcatgtgttttttatgaggctgctatatgtctcattcaattaatgcataaacataatgtgttttatattttaattaaataaatgcataacaaatattaatcatgcatgataaagactttaactttcaggcatattgataatataaaatttgtacactggtttttttccacagcaaagcaattattattattatagattaagaagactgaattttcacaaggagtggcaaattattcaatcacaacattatacagagaacagtcccgtgagtgaccaatttgtacattgttaattaactaattagaattcaccttaaatatgattttaaaatggttattgtaaagctcaataattttattatgtatgataatttattattagatgataatgtaatttttacataactaagttaaaattaattatataacatatagttagtctaggttaaattgaacttaaatctcttgtatatatatatatatatatatatatataatatagttttagggtttgaattttgtagatagaaataaaatttttggaaaaaagatcctactaaaaatgatgaatctaatttttcaatggaaataattataaatgccttaaattcacaaattttcctttttgcttcatctctctccccatgaattctagcatcggatttcaattgaatctgaaacgtaatagaccttcaagatgaaataactaatggatgtcttccnnnnnnnnnnnnnnnnnnnnnnnnnnnnnnnnnnnnnnaaaaaaaaaaaaaaaaaaaaaaatccatcagagaaaactaccctcgtgatcttgctgttttatatcttaaagttgaggtttattatataaaaaagtactaacagataaaaacatttatttaagtgttaaatttgtttttattggttaataaaaaaataaaatattaatatataaatatacattgtgaatttatattaacaatatgatgtataatactaatatttgatgtattaataagatatactcatatactaatagaattccctgtttgtatcaagtacaattctgttaatataaagtcttaaatctcaatatcaacagtttaatttttatcaaacaaagactatatattttgaagtcatataaaaaagactatcatatatatagaagttaattaatctaattttaaattgtgaacatataattcttttagtgattgtggcttttaattaattaatctgcaaatcatgattggaaaaaaaatactattgttattgcgtgatagattaataaaagacagaagaatctagatagataaatgaattatacaataaacgaaggttggtcaggaaggagtatgatccatatatatgggtccaacaaagcattgtgctcgaggttgtggagggaaaattgggggtcacaggggaaaactagcaactagccgagcacactaatggaatctaaaaggctcgaggagagttcagagcaacaaaaatacttttatggaaggcaagagacaaggtaggagcagggatatgtgtatggaggatattgttttgttgtgatgattaatgggcacgcatgtgaatggaggtgagtacgtgatttgtccttgtggaatggtgacaatactggaacacggaagcaacaagaacccaacagctctaaatacatatcatatcatatgatccttgtcattaatatcatatgtttatatctctcggctggtatataagctcattataattaaatacactcatcaaatcatgtgttgaagaataacttgaattaattaaaatcctatgttctttgttattaagtttgtgttagggtaatacaagtaaaagtgacgagtgaaaaatgatcatgagccaaattattattaacattttaatgtcaaatgcgatcatatcacagttttatttagaactatataataagtgtgtttaaacgaaaataatactaagttggatgagggggccgggttaggataattttccataagattctaggttcaagatttattattatcattatacaaaagaaaaagaaatagtagcattctgatgtttggatatgcaggtatatcagtctctttcatgcctttccatcaactcttttcatttctattacttgtacctaacaccatagatagttacaattatgaatgtctttgttttcagcggaacaaaatctttgagcttggaagcacggggaaaaccacaaacaactatgaacttcaaagattaaaaaagaaatgctaatttatatgttgttacggttaaaagaaaaattatgctcagggtagagtcccctcccatttttttcccttttgtttggatatctcatacctttcttataaaaaacaaatccgttgtgaaattaataatgaagtttgtccttcctttccagcaatgcatttctgtctacttgaattattgacaatttgacattatagagactcctaattaacagcttaactcaacacaggcagggcaaattagtagcttgtggtggtttagtccatgtgattgacaaaaaaatgatataattttccgaaatacatttggcaattgttagattaatactggatctaattaataagaacatgatcatggatttatgtctaactatttttttataggtaaaaggaatttattgatagagaacaacaggtactctaaccacatacgaaaaagcttttgtactaaaaacacagagaaatacaagcaattggattatgcaccaatcaagaaaagctaaaagtttgctacctagattagattgaaccaagaccacgagtgaaagttaatcaatgggtcatgaatttatgttaaagttaaatgcacttatatatctttttcaaacggctgtataattagtctttttgtggtattaagaattttttattattagaaaaaaaattattataaaagaagtacaagaggtattccaatacttatatacaagaaatccaaaacatcttcatttatagtctagttctttaataggctttctatacatgcatacatgacaaagggtagaaggaccaatcttacaagacatacatctactttagaaattatctaagtctaagccaatgagtacaatttaataatatctacagttaaaagtaagttcattacggtgtaaacaaattaactagagatcttgcaaattaagtcaccgtccatttttttcccttcaatttattcctcttaatcaaactcctatgctgaatcaagtgagaactaaatccaacggttacactatagagaaatcacgtcatgcatcaaagctattaaattccaatcagctttgttaagtggttaaaatttcctttatactctctttaattttattcacttatgtaaaaacttgactcgtgcgtgttaacaattataagacttgagtttataacattcaaattatttcacttaattaatgggacctgttacttatacatagtgtacacgtaagttgtctagttaaacagtaaacgtgactcttgggttatatctttacaaaatcaagaaatttagatcagaatcagatgcctttttcaatgaagaaaagaaattaataataaactattagtatgatatccgctgagcgtttctttattggacaagctaataattgcaacgaggtaaaagtggatgcagtaatttcagtgtccgtgatttgaataccacagttcaagttatatatacagaaattaatccatatcatcatgtgaacatccatgtcgaatttatgtacagcttttggatatatatggaagctagacaagagataattatgtatgaaaattgatgcggtttcaaagctaataatggattctaatctgtttattggcactgcatggaacctccagctagcaaggatacatgttataatcgtaacatatgtacgaaacaaaagcatataaatcatggcattttaatttcactttcaagcgggaaaagagagagaaaaaaaaatgaaaatcagctttaggtgtctcatacgatgagaagggtgtgatggcacgtgtggagagagaaggagaaagaagacaaaagtttgattgctggttcgagaaaggatcgagagtggaggagagcctaaaaagcccccgtgaggagtgtttggaggcattccaaaatcacaactaaacatccttttgttgcttctccttcacttctttcgatggccaattttcactatcacgagttgatgattccccttctcccattttttcttccaactcaaaaacttatgccaaatattacattttttccaatatacccttgtgctgttcatagctaaatataattatatttccttagtttaaaaactaagcggtacttcctattttcctggcatacagctatatatataaattaattacaaactatatatataattgttcctgtaaaactaaaataattaaattagatgttctcatgacttgagtttgaatttaaaattctgttgatttattatttattatttcattataactctttcataaggtaatgcatatcactcaacatattattttgggaaagtttagtattaagaaaattatcatttttttttaaaatttgtttcagaagttgacagaaattattattgttttaaaacatgaaaaactaacacccttaatttttatataaataaataaaaaagaagcaaattcaatgatctagtatactgctattagatatgtattatattaatgaaattccataatcttctagctgcaccacatcaataatcaataagttaacacttggcaaagagaaagaagcatttcaaaattgggcaaatggaaagactccaaaatatataaaaagggtacttttgtaaaaccaaaatgtatatagtatttatttatgaataaactgagacggtcatgtgggaagaaaacacatgagcatatggatttgagagctcatcccttcttttaaatgaccacagaactctgcagagttgatagcaaaagaaaagcaccagagagaaagaaagccagaagaaggatcataagaggagagagagaaagagagagcacacaaaatggcttccaaagagcaaaagagagcagcactgcatgagaagctgcaacatcttcgttctattactaactctcatgctgtaattccctgcattatctcctctgatatctttctttccattggatttctccgtgaatattctcaatgaaataagccaattgcctaaaagaatgttcagttagacagtaatattgttatacagttatatatactcccctctgctattcaattcctcttccgaatttgattccatttttgttaaaggaaacaatcttccttgctatttttcttattattcaaatattacatagtcatatatataattttctttatccctattgaccaaatccatattcattctttttgcatctatgattatctatctatgctctcatttccatatatatctgggtagaaaactgaagcacatagaaataaaatgatttatgatgaatattaattagtccaatgtaatattattgaaaatagtgatggacaactttctttaatttaatatcatttgtcttgtaaaccaacgcatatatatatatatatatagttgtttcctatcaattatatgcagcttattgagatagtaaactatctaatcattattattattattattattattattattattattattattattattattatatgaatggttaatggcagctaaataaaacctcgatcatagtcgatgcatcaaagtatatcgaaaagttaaagcaaaaggtagaaagactgaatcaagagatagcctcagcagaaacttcaagtgtcaacaaccctttgcctatggtattttcttaattgagaaaagttaacagcatcatctatattcaacaactccagtacatatatgtttgatcaagttccttgcaatataaaaacattgattggagtggcatttttgctgaatggacttgtgcaggttacagtagaaaccctagaaaagggatttcttataaatgttttctcggcaaatgggtgttccggtctgcttgtttccatattggaggcctttgaagagatgagactcactgtacttgaagctagggtttcttgtacagacacttttcgatttcaagcagttggagaagtaagatatacacatacatagcaaagaaaagctattacaattgcttatttattttcaacatgtatatcattgatctctctcactcccttttccttgaatgttatcaatactttaggacgtcgcatgtgttgtccttttataaaacgttccttattgggggacgccagtaaagggacatagttactgtgtgcattaattgatggtcatgcatagacagtgttaaattaatcttaaccttaacgataatagtgttcattaattgtctaccacatacaatgtctttcagtaacgaattaatattatacattttcttgcatttttctccaatgtatattcatgtatataagaatgacggcaaaatatgaatgtaacttttgtagaatgaagaacaagcggagacaattgatgcacatgctgtgaaacaagctgtggtacaagcaataaagaattggagcaaaagtggcgatcaagaagagtaaatcagtttatattaaaaattggaagctatcttgtacgacgcttgattcctcaaggaacaatttgccagttagccaacatgaagcaaaatgggatcagaaaaaaaatggaaaatgaaatatatatatatatatatatatataatgccagctataagagaatgataaagagtagttgatggttgatcaaatttatgtatggagccagcatatacatatctaatataatacccacatatatacatataatgatgcataaacaaatgaatatatagtgcattttttaatatatatatatatatatatatatatatatatatgaggtgtcgaaaattataattaggttaacctcacgatgtaatgaatgaatgattagttatgagtttaattttcttcaaatcatgccaagattagttccctggacaatgttcttaaggtcaaaagtaaaatgaaatgaggctaaccagatgagacacgtaaaacttgaaatggcacctccctaacggagtttagtacaaagaaaggtaacaaagatgttgcctactgaaacttcaagcaatgaaagttgacacctcttacacatggaatacacaagtgatgaatgttttcaagttaatcatgaaccgaagacacgtgacctcacggtcgctcaggagctgcaccatccttcagcttataaaaatggtctttgcatggtaaacaaccgaacgtataaatttgtaaataaagtatattgggcctttattctttacaatgggcacatatgttcttctacagcgccctttggactcttgaacattatatacataatggggtacgcttttgaaagtatacactatacaatttttggatgatttaattaagttttaacttcctaaattttttcaaaatttagttggtattttttaaacttttgtttcattaattaagatttttaaattttttattaaaatttttagttcctcaatttttgtttgacagatcaaagtccctaaatttttaaaaatttcaatttttagtttctcaacaaaaattttaacatattattttaatttatttaatgagatttcaaggaataaaaattaattttttttaaaagtttaggactaaatatcttaatggagaaaagttgagggacattgaccagtcaaacaaaagtttaggaactaaaaatcttaatagaaaaaaagttaagagaccttaatcagtcaaacaaaagtttagggattaaaaattgaattttaaaaaagtttagggactaaaaacttagttaaccctttcaagattgtatgagttatgtatatgtaaaaataaattcttaatgacttacccttaattgttttatgactctaacaaaagaaaaaaaatgcattaatatgggttcaagacttcaagttttgattgcacattattacacatatgacctttaacaacattttttgtctgatacttaataaaaatattgctaaaacctttgacaacatttcaaaaatattgtcaaatataaataaatattactaatatgctttcacaatattttatcaaatgttgtgtatagtacatgtcgttaaaacctttaggttggggtttaggtttggatcgggtcaaagtggtttgggtttgagtcggagtgggaggaataggagtttgggttggggtcgaagtggaggaaagacattttgggtttgggttagagtaaagggaagagggtcaggctccatagtggtttgggtttagttcaaggttggagtaaagggaggtgaggtttgggtcgaagtggaaggaggagagggttgggtttaggtttggggaggggtggagggaggacaagtttgggttagggtggagggagaaggtgttgttggtgcatgtaagtcacaaggagactaggagttgaacctggacttgaatttttgttgacgtatacttccactccaannnnnnnnnnactccaagtgcctgtactcctagtcacacttaagagtttgttttcgatatcatccacattaggtgtatcaataatgatagaatctagattagttagggagtggttgcaaatggtcgtataaatttttaaggattaaatttttcaattacacaaaaacacatgtatgtccattaggcagatacctaagccaatctatgaaacccttaattcaccttaaaaaccgcataagccactatatcagggtaatcaaggtctttctcatattgtaaattgaatgacacattgcaaagatactgaaaagtaccctaaaaactttgtggtgctagggtttattgttaggacatatgatatttttcaaggcatcaatatccctatgcaggtgatacgtaaaatatgtttgcaaagggcaagtgtaccctacacaaaaatattgtggactcgatagtctagatatcgtgccctagagactagttgtattcttaaataattcgatttgtataaactaaataattttggaatagaaatattacaattagaagccccaaaaatattactcacatactttttccaatccaaaagtgttctcacactatgcctaggtcactcacagagtcaaattttgtacacaaagcaaaaggaaaccactcccacttctttcccttcctatctataattaaaatgtgaaacttttgacgtggaaaggagcacgactgtgttgagcagaagcatgacaattctcgaaaaataatgacgttgatgatctttttataaaaattggagaacaaccatctcgaggagttttgagggtgttctgaaaagagcacaatcgttctcttcattaaagcgctcttttaggcatgggtgttcaggacttagcatgggtgtgttttggattcaacatgagtgtgctcttttgaccttttttctcaaccccttttatgctgaatttgtgcattctatcactctcaccttatctatatcacattttaacagaatcccgtgagtttttgcaaataaaatcaaataaaatgcattaaagcaagaccaaaacttatgtataaaaccacacaattaccagtttattagcagggtcaatcctgagattttttgtgtcctagataaataaataaaaaatagatcctcataattattgaaattaataatgttcaccttgaaattttttgttgtagaactcattaataatccattaatagtaagattatttaaagcaacgataacatgaataattaatattattttaaaattcgttattaacaataacatgactagttaatcgatacaaaatcatttaaagcaaaacaaaattatttaatctactttgtgacatactatattgcaaataaaattttaacatattcatttattcttttgattttaaccctccagtttatcaagggaaagagactctttttaatccggagtttggccagaaaataagtaaagtctaaccaataattattcctgtcaaggatcgaatttggatactacatgaatgattcaaccttaactttattacattttcaattatactaaaagactttatcaaaattgaaaatgttaaaattttatttgtgatatactatgtcacaaggtaaattaattaattaattttattttactttaaatgattttatactgattattaactattcatattatcgttactttaaataatcttgattataaatgaattattaatgagttttacaataacaaaaaaatcaagatgatttttttaataattataaatacataattttttttattgcccatgacgtcaaagatgatcccaggatcaaacctgagaattatcatattctagagaatttttaatttttattattttctttttatgtacataatttattcctctttgcattttacaattcaaattcaattatacagaaacaattcttcatggtcacgttattactaaattataatgttatataaaaattaatatttatatagactaaataaaaaatttaataccctctaaaaataagatcctaaacggtcacccagcttgagggtgctcaggtcaggcgaaaggtagcctgtgcccaaaaaagctcaactagttagttgaatcacctgtcaggctggcccatagcccacataaatagcccccctgttaagtatatagtttgcatccaattaaaagtaagctttacttccaaataaatttatatttgtgacaaacttctatattaacaatatttgtagtgagttagtttttttttagataaatatctattcgatcttaaaattatgaatcgataataaattgatatttaaaagataaagatttaaatttagttattgaatatataaatagtataatagattagctagtataataaagacacatattttttttttcaaaacaaaaagaaaacctaaacaattgagtaaatgcttgaaataaatcattaaatatatccgtgtttcacatttatatttttataaataaatatttttgaaatatgtcttatattattagttaaataaatatgatccaatacgaataatttatactaaaattttatttaccaataaaatattatagttctttaattaaaacaatatcatagaaagatatagaacttttttttataatatcacttgtcttttccatttcccttttacatgggctttatacaattcaatcaccgagttgatatcagaaaatagatcagtagggaaacttttttacatggactttatacaatttaatcaccgagttgatatcagaaaatagattagtaggaaaacttttctgtttcgcccatatgataatattaaatataagtaattaaagaaacagaaaagattacaacaagttgatgatatgatagaggaccctctcctcatctatgtggaataaaaatggctaaatatgcattattttttaaaaatatttaataattttagtaaggactgaggagcccccattcaacaagctgggccacactgggagcatgactctgggcctgtggttttggctcaccagcacgattctcgtagtagcgataagccgcgaaatcagacaacactgccagtgttaacgctagggcatgcaatcttcaaaccaaaacaacaaaaaaataaacgaaaaataagtaataattaaattcagaggaacactattatggatgtgaatttgtgtatgtaaaattgtggatttgtgggacatgtgatgtactacctggcatggataagtctaagactaggcttcattggagaccttgcacgcgaattagccacagtccccctacaaccaacaccattgtaatttagttataatgaaatttatcaccaactataaattttgttataatagatagtagagatttcacatcgattgaatattaaaaaaatattgttttgaatcagtgatatggttacaaatatttttttttcatttatggaaattacgaatgatgttaagaatatattctcaaacacattcttttaaatataatttattttattggataaaattgattggaactataaaatcagaaagaaaaattgattaaatagaacatgagacacataagagaatgtgtgttaattagagagtttttctagtgtttctctatgatcaaaatagagtacgtgagggaagggggaaaacttgttagttagacataacttaccaactgtggctagcatgtgctttgaaacccaaaattgaattgcatccatgtagaatcttttgttgctcgatctcttagatatgctttagaatttaccagctaggtgggggtgatgatgagaggttgagggtgagtatttatagctaaggagatgagggtaaggttgtaatttgagattcttttatatatggtcccttggtttgttaatttacaggggggtttctatctgttttattagaacagtgaaaaggttaaacaggaggaggctttgttttggaggacggtgttgctttaggtgaagtgatgagccttgtggattttggtagttgtttaagatacataaagccatgattaagtgtttaatgatagatggaataaaataatatgtcggcaaaaacaatggaggataaaaaaaaatatgagatacaataaagttattattgtattatgtaaatattttatgatagaattcattaagtttatattttacatatctagtttaatttattttagagagtacttttataattatctgaaagtgttttggaaaaatattttttaaaactgatttcaaataaaaataaaaataaaaagaataccaaacaaaaaggagttaacaaattaaagtaaaatataacaaactttaatttatgtcattttttactgttaaatccaaacatattataaattaaatgaatcttcacatgcatatttataatttatttttatgtaattacacatattgtgagtactgtgaatactattataaaaattaactttacacacgtattggtgttaagggtttagaatgtatgattgggtattttattagcgttaagtaaatatacgaattcttaaaaaaaaaaatcaaagtaatccttcgggaaaaagataatcaaaatttaattaaaagataaataaagtttgactaaaaattatttttgttaataatcaaatttaaatattattttaatatttaattttaacttcaatatattgaatcatttgattcattataaaaatattttattataagactaataaaatattttcatagatgcaaagaatcattatgcgtgtcatattgttgttggctgaattggattcgatatcaacagggtcacctaatataatatattcatattggtataatttattttaatatataatgtcaagcacatataccttaacttttattttgtagtttaatattattcataacgtctaaatttctgttaccaaaatattatattaatccaactaaaaaaaaatgaaatcataattttgatccgaatctgaatccaaatagttagtttaatcaaaatatcaaatcaaaatagggacaagttactggaccaaaaaaggaaaaaataagaaaaggataaggtcaagttagacgcgtccaaactctaccataccaccttatgcttacagttaaccaaaaacacctgcatgaattgcatttcacgccaccattaacatggcctacatcgcatgtacttcaagaaataaataagaatttatattttagcttttataaaaattttattatttttagattaaagtagtagttattttaaaataactgttttaaaaattgacacaatgataaaagaataaatataaagtcttccacgtggaaataatagaaatggatcatagcatttcaccccagaaagaaaaaaaaaggataacgtagaaaggagcaccacaattttgacaagttggtgacgcgatcataaaagttattagtagtattttggagctggtaaagccgttaaaaacaatgtattacaaaaaaaatattactattggactggttttaataaaaaaaagaagttacgttaaactattaatgaggcctacgaatgaatattggaaaagtaaaaatctatttggatgagtttctttaaaattatttttgagagaaaaaaataagaaaagaaaagtgagatgaaattcccgattaattaaaatgagctattttaactaatattaatcaatttataaaagttctttatataatttttctaaaatatgaaaagacatttacaaattggttaataaattatttattttagtttatccaaaaactcatttcatttttgggagtgaaaaaaatattgtacaacaaaatcacaattttattgtatattttttgcaccccattagtgcaacaaaaatgtaatttcattgtgtaattgtgggaaaaaatgcacaatcaaattactatttcattatacaagtgggggataacaaagaatgaataatggaagcatgatttcattgtacaatatataacataattattcttttattatacattttttcattattcgataaataaaaataacttaagtattaattgcttgatttgtaacctaacaaaattacaattcgcctttgtcacaatttatataacacagacaaaattattgtattacataaattacaatacaacataatcgtaattttattgtgttaaagatattgtaggtggggaagagagggtgccaatattgggagaaaggatacaaataatattttgtcatttgtgcattgatagtagggactagaatcaattttggagttgccaatatcaatttccttaaaaatattgtttcctataagtgtttttatatagaaatttatcaaaagagaccgtaaggcctagcccgtgttggatatgagaaggcctctgtacgaagatgggcctattcatattacccaacccaaattgcgttttccgtgctttcttcttcttcttcttcttcttcatcaaccgaaaataaataaataaataaaaaattcccgctaacacagaagcttcttcctcaatcttcttcttccttctcgtacttccagttaaattttcgcactctcaacttcattttcttaaaccacagtaaaatggaaagccaaaaccaaagttagaagaagtaagaatggaagcaagtaacgaaagacgagtgctacctcgcagaaagcctctctccgatcgcaccaacacttcttctccctccgttgttcccctcaaacctcacaaaaccaaaaccccttcttcttctccttcttccgcaccccctaaatgcaccaccaccattctcgataatgccccaaaccctacctctccttctccatcgctcaaaactccctctccctctctccacggtaattattcattccagcttagcaatgcttcactttgaatatagcatgtttaattactctgtttagttaccgcctataattggcgttttttttctttcttcttttcttcagagattgttgatgttgaagcttctgagcctattacagtcgtgtacagccgaagacgttcttcaaataaaagaaagaaggataaagggaaggcagtggctgttcctttcactaccgcgcccaatttcaagatctctcatacttggtaatcgctactaattactactattacccttctcttttgcctagtggaagttgtattgagtttaagaaacaatgattgagggagaataggaggagtgattttcgaatttccgtgattgggtaattaaatgctatacattgtgatagaggggattttaagagaaatgctagtagcacactcttttaaacacattgtctattattatttgctgaaatttattggaaattataaaattgtgacacctacttctcatttaatgaattttacttatgattctctagtttctactaaattgtaagtaacagtggagtttattagatagtgtgttgctacttaaacatttcacagttcttcaaaggagtttgctaaaatatttgtggactttgctgtttggattggctatatatgtatgaatgcatggaaaagtcttggtcttgtgaagctttcctgaatagattactgattcagagttatccctttttgtttcaatttttttttagtcggtcctgctttgctgttacaatgctttatacccttaacattttatgtttcattcgattctgttttggtatctatgttatagttggatagatccattatgtctcttgtcttgatttacggaattggatttgatttttgctttttattgtctctttcctggaagttctaccatataattattgttgtgtatgattttgtgatgaaaaaacagcaatacagaggatgagtttgaaggtgtgaacctacccaaggccaaggcaatgacagttcctcgtacaaaggtatattaggaaactcaaaccccttgactgtagggatattgaattggttattcaactagaaaatgttcttgttaaaaatatttcaatgagcattttgcgaggattgtttatttactgtttaagatgagtattcctgtctttttagtgggtatgtcaatctctggcatgagtaatcttatgtctgtcatctatacttcaaacaattttatgccacctcccttgatatctacacagacaattttataatgtcaatgaaatttattcacatctaaaatataatgggtattttcactatttgtaggttttgaatttgtgtgaagggtgaatcttgatgcaatggtaagattgccacctggtgatctggtcacgggttatatagcctcagatacaatgtatccatccattgggatatagtgggaacctttttcactggaccaccatttttatagcatttggaatagttttatagtgggtacaatggaagttgatcacatttcaatcgcagatagttattgtgactcccaactatttagatttcctttgccatcacacgttactcattgtcctaataaaatctttgaaatagttgttgggtggaagtagaataaataattttctggtactttctagctcagacacttctgtttccaccaaacacatgacattttcttttggcagggggcttgcttacaggctatagattctgcatacttcttgtttcatgttcaatcatatcaaaataaatattttgttagtgtctgatgcatattttctgaattttcagaaacagcgtgctttgtcatctgaaaaagatgagttcaaggatcgccagctgcaagaatttatagaaaaacagaaagcttactttaaagagattgatgaattcgaactggaggttgaatctggtgatgagttggattaggtggaagagatgtaatataactataaatagcagcttgaaatttccatgttattgtaggttgtatagttgagatatcgtgattttcacgatgaagtaactacctcacagccatctctgacaaaatatattgtaatattctggtgggaacaatcgaagttaaaatttttctgcccaacactgtaacacattaattgtccttagttttttttcttcttatttctcttgtaaatttcttctcaaagttataattcatttaatttgtgattttaatgcctgctttgttttaggctgatgattctttaaaatccttagcgagcaaatgcaaagagatacaaattttctggatagatagctagatattgtcgttcatttgatgctataagtctgctggttatgttgattgtcgtgcatttgtcaaagtcatgtgcatatatggtatacatacaaaactacgtagttttgtgatgataaaccaggtcgcttgacagttcgaggatcaaattattcgacataactttggaggagggaaataaaatttatattaaaaacatactatacatcataacttgctaacgtttaattgactttcccacaattgattctgatctggcccttgcttcctgtgagaggcttgatgttgctcattttgaccatgcccttagcaaagtcttcaaagaatgcagcagcattggtagcatattttcttaccagattgtcagtagaactgccattgaacagctcctgatcggaatggagaagggccttcttactcaccaaattctgaaagtatagattatcaaaattgattggagtttggtggtcaagagcttcgagtgttttgtcatttccacttctggggcacttgctctgcaggaacttccggtaggagggatcaacgttggaatcattgtagatgtgtgctctgaaatttttgcattcagccaggccaatggtatgtgcccctgttattgaaaagatgctgttagtaagttgaagcactttgtgaatatgggaagccaaaattgaattaggatcctgtcatttctttagtacgccagtgtttttaaataggcagaggaaaacacaatttagtgcgggaaatggaaggtatcaaacaagnnnnnnnnnnnnnnnnnnnnnnnnnnnnnnnnnnnnnnnnnnnnnnnnnnnnnnnnnnnnnnnnnnnnnnnaggttgagaaaaactcaaactgacgagtgatagttttaggtaataaatagataggaataggacaccaccactcttaatcatgacaataatcgggaaaagattttttatttttattttatttttttattttaaaggtaagagtctacgataactcattcaatcaactagttaaatccccttgataaaaggattgttttgttactcacttaacaaccaagacttgagagtactagaatccgttgacatgtagaaacaaataaagacacctagatcaatacgatgggatatttgataatgaatgaatagagtgaaaaagagataacatgagatgaactcaaatagaataatataaagtgaaataaaatgcccttgattatttatattttatgtttaggaagaaatttttatcacattatttaagaagtagattaaacggaataataagaaaagtaataaataattaatcggttcaaatttcatacctcaatggaaagcagatgagtaaacaatgtttttgctggattgcatgaaataaaataattaaaattaagtgaaaagtgagtttttaattatagatatgttcaaaaaaattataataattatgtaaattttaatttgtttaaaatgaaaagtaaaaaatattttagtatttttcttaaaagtgaaaagaattagtttatggaaaaagctctggaaaggccgaatcacaaatttactttctttaagctcaattaaatggactatttatcaatttttatttaatttcagccaccttatttttaataattaaaacattgacgaataatatttcccatttttttgtcattgcatttattcatttttttaatatcacttctattcatttagttaaaatgaaaataaagaacaacaatttcctcactttttttatgagttcgtctctcgcaaattctatttaaaagggattatttagtcaaataattaaattactaatgcaagaaaccgcacatgtcgtcacaatcactacacatataaaagcacaactttaatttggaagccaaacgtgttaaaaaaagcatttgttttaacttatttttgtggaagtcttctatttttggaaagcatttgttttaactgattcaagacatcttataaattgttatagcacctgaaagagccaccaaatctgtaactgagaggccttgattggcaaaattgtttatcagagcagttagactgaggaaaggcccaggaatgctattattagcatcacttctgcttgctgtagtagaatctcttctccccaaccccacttcccaagaaggtcctcctaactgcaaatgttttacacaaaaagatatatagtaagtgcttaaattcaagggccataataattgataactttgactgggatagaaatagaatcacagaatattagtatagtagtattacataaactacagagtctctagctgacaaagcaagaatatcagcacatgacactactctggggcattctttctccacactggctttaatatcattaatcacgttgaaccctctagctgattggttgttagctgctgctgtttgctccccaatgaagttgcttgtatcatccaacaggattgatgcatcacaaccctgaaatatcactatcttaggaaagcaacttcgaagaaattattagatagtttcagaccactacatgtttatagtttcaatcaatctctacgtgacatttattcaaaattttcaatttaaaaaaaaaaaactaataatacttaacacttaattacttgtcatataaagattatttgaaccatactgagccagactacctaatgatttctcacaacttgcagcctatacaaaaggttacatgaagtaaacataaaatgtatgttatattaaactatattattaattatatactaacgtttacaaagcagtcatggaaatgcaatcggagtaaggaagcccctatgcgtgcttctttctgaatggcttcgatcactcctttcttcactataggcaacaagtttgggcaggtgcatgagtaaaagtctgtacatagttctgccccagaagctgtagttgcaccgacgagaacaagcaagaggaagtagtaagaagccattggagctttcgtacagaagacatacccaatcattgcagctatctcttatacagggttggactaaattattattatttttaaaaataagcgaacatgtgtatttatgtttgaggcacaaaatgtgccaagagtcatttacaaggatatacaccatatcccctgtatactatgtataccaatgagattgtggtcgaggttaccaaatattaacagtcatagttgtaaatatatgaattacatgtaaaagggcaaaatagtataggatcaatctgctgttggttgaggtggtgcttgatagacataacaggataaaataaaatataagaattttatttgtgtgacataaattaaaaacggaataggataaaatatatgatcaattttcttttaattctattaagatagtggaacaacaaagaataaacaaaaaaaaaccttttttttaattgtatgttcttaaggtgtaatttatatttatttttgttaaacaaattttcttaatatcaattagttttaagatgaaatttagtataatattttgtttatgtacatcaccttatatggtaggcgtcaacttgttctaacaaacatatatgcgtagggtgtgggaaaatctcaaatcatttttctcaaacatcaattaatgtttaaatgaaatctaacaagagaaatacacgatctaagtaactcttatatttgtatccttattgattaagtatctaagtactcatgcttaattgttaccaacactttaattaaacatgaaatatcaatgaattgaaaaaaatatttatctagtgtatctcccatgtgttggttagtcacaactcaataacttatgtatcatacaaaatcttctatatatccacaccatttccatcaaactttacgaatatttacattatctatatattatggatagataaattctacatatactcattgagcctgattcccattatctccttaatggcatggttatgcattttaatgttattgcatgtccataaaaaaaaaaaaatcgaaaaccaataaaagcaaacgtaggattctttaattgatattgttggtttatgttatgtatagtcgaataaattattgttgaatggatttttattagtatttgtttatttttttataatactatattaaagctaagggtggagactggagagagttcagctatctgaaaggagtctataaactagtctacatttgacgtagttcagaccatatattttaaaaaataaaataggtcaagaattttattaagtctaaaatattagacttaattgaggtcattcaaaaaaatcttttaggaaagtcgacttatttattttggtgaatacatgaattaaaaaaaagtgtaaaggagagacaaattaaaaagctaaacttcagggcgtgcatcctataacacgagagcaagagcgctatctatgggagtgaaccaagtgttcgatataccagagttcttggatccccgacaaataagttgatctattaaagtaaatacgaataataattttttttatcagcattactatattaaaaaaattataatgtattaagataatatatttatttatccttttaaacatcgaatatgttgacttacatataagttgctttaaaacaagcataaaaatgaagatgatccacgcgaatgtacggatatgactagttatataaacaaattatattcaactcgtaaaatattatactctacttattatttcaactcttgtcctatgccttaaatagtagttattttaattttagacttatctaaaagcttcgaatatgcttttaaataagtaagttaacaaaccaattaaggcaaactttcaaaaaaagcaggtcaaaattcaataaaaatcgtgagtggtggtatcaaactagacttcaactttgaatttttttttttaattctattgtcaattgtagcatttaatgaatttgattatgtgtaggttgattattcgtttaaaaaaattcacaaaatttccattataatctgttttagacataaaataagctgttttcaacatacttggatgaattttcacagaaaaaaattcaagtatactattatagatatttttagtactattatctaatttaagttagagttttatatttaggcataacatattcattgaaaatttacaataaaaattgaagtgagttactaagataaattagccctaattttaattatagaataatattaaaaatattaacttttatctatttctagcttatatgattagaagtacgtagcgaatgatttcttttcaaataagtttgatagtctcgatctacttgtattggggaaaaaatgttctgtgagaaatcttgtgagtttttcaaaacttgtgcccttgaacaggctttagaggaaattatatatgaaaacaattgaaacaattgagagatgaaagtggttaaaaacttagttagactttttaatcctattaatcaaaattcgtaaataaataattcatttgaaacattttcatgataaagcaattgttgatatatatacattgttctggtatataaaaaataatcttatattactttgaaattgaggctaaatgtagtttataaacactcattttccttgagtcactgagagtctgggacatcttttattgacataacattcttgattactggtttcctctctttagaaaatgtgagtgaacatctgttctggagacttcaaatcgaaacacacaccatgcatgagagtgtcttttattagatcgtagttgttgtttaattttactactgataaaaaaaatctaagcacacacctagctaatctacttttaaccaaatcaataatttacgggtacaattattgcctcgtggcagtgacaatttttagcagtttcgttattccaaaagtgagtaccataattgtttcgccttttctgtgcatggattgctcctgtggggctcaatcactgttgttttgtgggaggactggtcccccgtgataggttcctatgctgtgacagaaattattttacaaaaatacatgtaaaaatatagattgttagtttttattttttatatcgacttaaatatatttttaatttttataaattatttttattattttaatttttgtaaatttatttttctaattttaatccatgtgatttggtattttttttaattttgattcatgtaagtttttttgtttttttttctttgtaagttaatgcttttttaaatttaatcacttcaagattttaatttttttttcatttataatcttatcgtgtttattatgatcaaaattagaaatatgtaaacttacttgaattaaaaaaaaaatcttacatgaatcaaaattaaataaacacaaacttaaagatactaaaactagacaaatttttttacaacaatcaaaataaaaagatacaaatttatataaacaaaaaatatatttaagctctttatatataatggatttacataaattatttaataaaatatgaaaaattatgtaaaaattcaataatatgtcattaatatttttatatttattaaaatgtgtcatcaatataaaattctttcacatattatcatttaattacaaattatcatattatcattataataattttactaactttcataaaattactttaaaagcatcattttttatgttattgtgattcatctttttgatatggtcatgtaccaaaaagcatcaccaaataatagtttctaattgttttatattactgaaatttttagtttgattttacatgacaattattgatcatatatattggaaagatgaaccacagtatcaatataaaaaaaaaaatcaaatgagctaaattagctgtccagctgcattgcggaaatttgttgcgatgattagtcttgaaaccagaatataccctgtggatagatcaaattttatttgaagcagaattaatgcacgatctatggatattttgacatcatttttgtgcttaatggccggataattaggctttttgttgcaagaggcttctcatttgtgacaagctgaaaatggaaatcttaaattaaggcgaaactatgaaattgtttgacttttgcaacgaagtattaaaaaagatatttctaaaattaaaactaagcacgcactgaatttccataataaaatcatgaaaagaaaggtcacaagaaaaggaattacgataacaatgacttttattctcttgaaataatataatactgtatttgaattcagggttcaggttagatgatatagaatgttaaaatataagttagcatgatttcagataaaaaattatatatgtaatttgaattgattataaatctataatcaattttaagttttttttttttttaagtcaaaagggaacttttacttcaatatgcccccacaaaaagtatgagataagatactaccaaaaggtccataagtaattttaaattgaaacaattttgggtatgtcttgatcaacatttagtacatgtttaaaactaagtcacatcaatttcgatcaagtctgagacaagtaaatattcatagttaattatgcatctattgtcaattttgatgtgaattttaggtctattgtaagtaatgtcattccgaacacacgattagtgtctctcaacttgagtctatggtgagttaaacatgatttttctattcactatgatgtttggtgttgtgttggaaacatgattttgagttttagattcaagtctctgctattagaagtaacttttgtatcaacactagctttagtgcatgtttgacaatcagttggtgaagcaccaaacagaggttgttcaacgcatcttctcccttacttctgcgtccatttgttggatctccatcatatatagcaggcgctgaagcaaaataaacgtgctctttgtttcacatatacccttagaagacttaagtcattttggtaattacacactactgaagatcatttttaattgtaatttttaaacaatattatatgttaaaatcattttttaatatttagtatctaaacaaaaattacattattacaaattcacagttatttataatcaattatgtaaaattactttgattcaaaataaattctatggcacatatccaaacattcactttgtataattttgtgttagataaaaaatttatactaaattttattattaatttttttaaagacaattttaccattaacttagaacaacaaaaatacaaacctttatcatattatttcaaaatcaattttaacttacaaccgcttaattacccaaatacacaaaaacaattttgtacaaatttaattatttattataatttttataaactgatttagcatatttattgacttttataaaggtaacatttattcacccactaattttggatttagttgaaatttcttaatcatacaagtagtactactttttgttctctcattcatgtatgaattgcttctgttcttgagcaaaagtagctttctcacaccattttcaatttcaccgacagcatcactagatccactaccttccaaatgacaggaaaaaaaacattaagactagcgtcactttttttatttaatttatttcctaaacgaaacagaccattaatatcaagaaaacctcaaaagtaaaataagataaaatttaacatctacatatcgaaaaaaaaaagataaaatttaacctctataagttataaatttgaaacatcactcgtatccttaaagtgatttaaatataattttactgtaaataatctttaaattcaattcttttagaaaaaaaattccaaattcaaagatttgttgtttttcccccctctcttttgttttttagtatttttcctccgtaatcaatatgttatctcgactacaggttagttagtgattcacagcttagctctaagttgcgacatttacaaaaagataagcatcagttcatgactcgataaatcatgagttcgtgacataaataaataaataacgagttttctgtagcaaaatgccaatatgcacagtcatattgtatctgaggttggggtgtcagctggggccatgcctttatcgatcatatttttagcttttggaatttggtgcctaattataaaactccataaataaacatacaaaaatcaatcttgaagttgaacgaatgacgtgacgtatgtgaactggttacagtttacactttacatggttgcaatgcaatattaatggtttcattttttttcctgaaaaatatatataatttttttattttgttcatgattaagttctttgtaactaatatttaaattaaatatctgtcttaatttgttcaatgcattaaaaaaaaaattgttcaacgcgaaataagattttataatgaatatcaaattgactttaataaacgcttttttatatataattcaacgattgactagtataaattaaaaatcatgttaatatatatctatagtatgtttagttaaatatttattcatgtcattaatccatgtagttacacccaagatatatttcaatagttttcttttagtttacttaattgtgatacttttacaatccgaatcacaaatgagattacttaaaaaaaaaaaaaaaaaggaactaaatgaaagcttcgttgaaccttnnnnnnnnnnnnnnnnnnnnnatcttttgccgttgttttttattctatttatgtttttctatttggtaagcaaaactgagatgacccaaagtatcaaactggcctgttataaagcccaacaaggtagcaatgttatacgatttggcaacaaattaagtctggcccaaggatgttttcttttctacctgatcaaacaaacattgtctgatacttgatcaaacactgtttaaagtctttaaggccaaatatattttatttgtggatttcttggatgttcaactcgaacataattcaagttttgtatgaagtaatattcacacttcatgcgtagaccgtagtggtaaaacaaggtgttcaatggagagttgaaaatggtgaatccattcatgtttggtctcaaccatggctcaacaatgttcataatcccgatgtctcatccaatccaaattctggtaattataatcttagtttctgacttaatgaccataatatttctgtttggagaaatgaagttctggaaagcaaatttgtactcttcctctcttcaacacatccgggaaagatcaattaatttggagattttctgcaactggaggatatactgttaaaagctcataccatgccattatggaacaattgctggacaattcacacctcaaggtcgaaggagattgatcaataatttggaaacttgcagtgcctcacaaaatgaaacattttctttggagactcgtgcgtaactgccttcaaaccagatcaaatctacgtgagaaacaggttcaatgctcactgaattgtattttctgtcaatcaaatatagaaaataaatgtaatctctttttggcttgtgactatgcaaagctcatttggcaagcagctgacctctggaacatgatagaacaaagatggaataatgctgaatcttttcgagaattcatgataagaacctgtttttgcaccattctttgggctatttggaaatgtagaaacaagaaactttgggaggacaatgaagcaactccatgttggatcaaaacggatcttcaaatcaaatgcagaaacagaacaaaaatgtaagaggagagagatagagaagaacacaatcagtatgtttaacgtgggaaaaccttcttaatgtgaagaaataaaacccacgggacactaatccagaaccaaactttcactataataataatgggttacaaagaatcaaaatacaccaaagtggtggtttacacaacctctccaacaatgatgataatcaaactccctagagtgtttcactaaaactctctctagagatatctcaaatgcaaagcacaagacttgctcaaatgtgctctcaagaatgtcacttgagacgtcaaattctgacctaattctttcagtcttaagtctaggtcagggtttaggacaacattagaggaggaagcccaatccaacaattctcccctacgacttcaatgcgttggtttcagcatcaacccggcatctgccaacaacccggcattttcaatgcgacggattcagcaatccaaccgggcattttcaatgcgacggtcgaatcaccctgagaattccacacattcgtggatatggtcaatcacgctcaatggagactcaggcggtgtgggtgatgagacatcttcatcgtgatccactattctatatggtaaatttgtccagcaaaatatgccattatttttaaaaaaaatatttaaatatgcctacctgtgttcattaatttttttaataaacaaccctaattaaatattatataggttagttaaaaaaaattaatatcctaatataacaacattgccatttttattatacattaattttattcactattttgtgtgtctatataaatatattaatatatatatttttatgacttcaaatataatacattaatacattaaaaaattataccatatgaaaagtttataaattataaaactagtttttgtacaacccacatgttactaagctacttaaatataaatactaaggtaatcacattattgatattatatttattgcaaaatcatattttaaatgatattttgcgtatattatgtgtattaatttttaaataatattgtcgaataattttgtaaaataatatatttattgaaattaatatgtttaattgtgatatgcatatatgtttaattatgatgtgcgtatatgtttaattattttttataatatatttaaaataatcaaattaaaaatataatgtatatataagtacaaattaaacacaagtattaaaaagctaatgtatatattagtaaatttagttatatactgaaaaataatttttttaaaatcattatgttcacaaaggatgaaataataaaattaaagcaattaaacaaatatatatatatatatatgagtaaaattaaatacaatgaacataatattatgttaatataatattttcataaatatttaaataaatttgtacctttcaaattatatttattaactataacatataattaattttaatagtattactatatattatatttttaaaataatatatttttatcaaattaaataaatatgatgctcacgcacatatatttttacctactacttcctaaattaatctataattaaaatatgcctatcacttatcttataacttaacaatcataaactaaaacaattatctatcctataacttaacaatcataaactataactaaaatatcctctaacctaatgtttcaaatctcaaacctatatattatttcaaaactaaaactatataaataatatattacaaaaattaaaatatataatgctaaattacaaaagataaaaaatagaaaaataataaaacaaaacttacctgttatactacacagtgagggaggggagtgacactgagagaggggagtcagagtgagagtgagtgagtttcagaatgagagtaagggaatgatggatgaaggaggggagagatttaaatagtaggtcacgtagacgtaatttgctagggcctgcagcgaattcgtccacacgtgacacttgtccacaacgattctttttttttagatcgttgcacctatttcgctagggccaagtgaaatacgttgtgtgccacgtggactgcctgttttatatcatgtatttcgcttgcacttgtagtgaaatatgtgaccaacaaaatgacgtcacatcagctcacgtatttcgataggccttaaagggaaatatgacgcgtgagaatctggaaaataatattgtgtatgtgacatttaaggaattttttttaaaatttgtggcagtacgattagtgtctccatcattacggggtcaagtgattgaggatgcgaattgggtgtcaaatatacgtgatcaaccatttcttccccagtctctgcaaagcaaagtgttgggttcaccattcttatcttccatttgtcgtccatatatcttgcaagttgcagatgctgcattaattttcaataagtgatagctagctggcattgtgttaatattgtgtctctgttactcatttataattctcgctgataatgatttgctaccaactgggagaagaacaaactaactagcacaagcatccaaaaccattggcagcaaaacggggacgaaaacactgcttatgattagattgttcctttagaacagtaagcggaacatatagatagcactttatggcgatgcatatgtaactcatttgactactacaacaggaaacattagtttatacacatcctcttcttatatatatatatatatatatatatatatatatatatatatatatatatatatattttannntaaatttaccgtgaattaattatactaattaatttgagcccttttttttctgaatgtaacgtgaactacaagaaattcattcaaaataagaaaaacgtattcagagtgctgaaaaatgaattgttctttctgcatgtccccttccatgaggacctggagtttaatggtccttgaattactgatcaaaggataatgacttagaatgacttgtctaatggtatactatgaggcagtgatgtgtagctgactagccaagtgtgtgtatgaatatttaaagagcatcagaaccttgcaaatctagcagtatactatgaggcagtgatgacgaaacttgacacaaggccgaaattccaccttataaacacaccgtgacagcctgacaggccttccttcacaaactgcctatgggggttggcaaaaaattggccacgcattttgccttggcagtaccatgaccgctatgtaacaacactggtctgtggccttgattcacacagcctcaagatttttgggtacacaccttgatcgcattacagtcgcatcggcccatttaattactagagacttaatttcccaaaatgttaaaaattacaacgaaattataactatgatcgcaatttaaaacctcttgctaactagtttctatagtttcaatattttttcttttagctcttgtacttaaaagcatcttctagtccctacacataccgttttaatcacacaatttcagatctttatgcagtcagtaacaccgtttggtcaaccgactctgagacagtaataagctgcaacaactactggccattgtaatttctgagtcggaatgatgagaaaattcaatgctagctaggaatgagaaatagctaggcgtgtgaagaacgaaataggtcgttgctcttgtaattattataagcaactatccaaagaatttgtggacacgctcctatatcaacttcccttggctacaggctttcaccataaagattttttcaaattttgcaagttgctcattgcgcgcgcgcataaaagtttatcataaggtgtgaatatatatggagatctttatattgtttttttaagtcgatgaataattcttcacagcactaatacattttatggttaaggtgttaattaaggagtcattgatagtgattagtgaacgtgtcgaattaatatatgtgcgccattttagttacatctatcctctacaaccatgctatgacaatgccctcagagtcttttaattagttattctttgacattctcagttaaatattgctgcatgtgtaatgattgatgtctccgttaacacatggctaattaaagccaatcatttaactaaggaagagagatatctaattattttcaagttcatgttcagaaacaagcctttcatgaagagcaacaatcattttaactgcacacacacatatagtgtagtacattttataggaaatgtaaaaaaacgaaagtgacgttagacatatttttttattctaataaattttttgcatataataggaagagagataaagaaaaatgaaagttattaatagaatatttaaaattttggatgtgtcaaaatattaccactatgcaagaaaataggaatacatataggtgatttgagtgcctgcgtgtgtgcatatatatatatatatatatggcacccaacacctctttcttaattaacatcacaccattgatctctttctccttttattgcttgcttctttagtatcactctgctctccctataatatacttctaatggaagccaaataagatgatcatacctaagatgcatatggtactgttgacttccgcggccagcctgcgctttcatcgaatactggcaaatggaaggcttgcatttttcttcttggtgaccataataatttctaacctgtttattaagcttttataagaatctgatttgtttgatcatgaacttcactaatattttaaacctttttgaagattacttcaatcttgaagattttgttctatagaaaagaagaaaaagaattatactgtgaaccttcttccacataggctagggttttttattttattttattcccatgcacgcacgttagttcagctctatttcctggttcttagtttaaactttaaagtctaaaagtacatgtcaacttatgagtcttagtgcttgtgaataggtactatttaatgactgttactgaggagtatggttttgaattgtggtacacaaccgcaattacggttacaacatcaaagtattttgtcactctgtaatcgtatcacgaccgtaattaggtcgcattaactgcaactgcgatttaaaaccatgctaaggagatacaaaatgaaaatatcaaagttccatttcatataacttgatatatgatgcttgagctttacttcttttattagttcaacattgcaggccatgaagcatttgaaaggatggccttctaaggagttgcttccaacttaatcagttaccttactacccaacttcatgaagatactgttccatctgtgaataactggtcagcatctgtgtggatgtacattattttgtgaatatggtataactttgggctacatgtatttctgatgatcttgtaaatggttggggcacccatttgtgtccttcttttttttattaatataagtttttctgtgctgattaaaaaaaagtagagatccttaggtaaaaataaaatcaacatcttaaggttaaatccatttttatgttgaatgctaacaatgtactaatataatactattttatttaaaccaaagtttctagcctcgtggcacaaatattgtgtaggaaacgttaccagaaaaacagcgaccgtgtagttatgtcaaagcaatcgacaatcgaatcttcttatataattagtaaatggtattagttaagctttagcgatggggttataataaaggcttgattatcttaatcaatagctgggtcaggctatatgtataggagattcgttacacttcgtcaaacttaaaatatttcaaaatgaataacaccgctttcattttctaatgatatggtcaagaccaatattctaaacctaaatctcctcctaattttccaaagggcaccagcatgcaattttctttaatttggaagaggcaccgtaggagggagtgtatgggccatgcatgcgcatggaagtcatctatttcctaccgtaatataaaaggcacaagggaacaaaatgtgacaaagttattccctgatcatccaaacttattgatttttatcatatttatccttaaagttttagttgaaatatacattttctttcatttaatccacttttataaagagtatcctcaacataaacttaaaagccgcgccatttttttcagcaatttttaatgtgtttggtaggaaagaaagaaatacatgaaaaatagagtagatgaaaattgagaatagaggaacagaataaatgaaaatagttgagaaataaagtaaaaataaaagtatttagtttaaaaaaaattaaaatcaatttttaagataagtaattgattgtgaagaattcatagttaattggttttggaaaactaaggttcgtttgattcattaaaaattattggacataataaatattttttatttcacatttgatttgaaagagtagagaacaacacaaatcaaacaggtaagaataggacaaaatctctaatttttgttattcagaaaattacataataactttttgtcatagatatagaatattaaaagacacatatattcatgtttatatctctttaataattgaaaaatagtaattaattaacgtaatcaatttaaaaaagacacaccaaattattttattctgatctctctctctctcttatcattttagtaaattcattaaatttgatatcaattctattaagataattaacattatgtattttaataaattttatattattttttgtccattatttgtcaaataatatatagggtaaaaaatcatcttaacttatgtttttgtcctatcttattcatcttgtcttgtttagtactatcattttaacgaatcaaatggatccaagatcaattcatgcataaaaaaatgttcataagtgattatgatcatcacataattgattatgtttgagttgaaatgcagtagcattttcacgctgatttgtggaagaagaaaaatatggaacctacagttttttatttcttatttccacacaccaaacatatatttaaaatattttttttatgatgaattttaattatatagaaaaatatataacctatacaattcagatgccaaaatactagtattttttcgctaaagagatgctaaaatactagtataataactagttccacggttttgatttttaattacaaaattaaatacaatcttcattatacttattttgtaaggtctgtctgtctgtcttttttttttttttttcaagtgttcatggtatttgtatttccaggcaagagtcggagattaaaccattatattgagatatggtattgtgcctcttttgagacccttgagcaatagcataattattcaacaaattatatacttaaaaattatttgaatgtggaacttaggactgtatcagttaatttctctcttaattcattttcaaaaacttggtattttccggctaatcatgatgagctaacttatttaatctaacacatgctattttttaggagtactatcatgccgttgttgttgtttcctattttatggggattaattagccttttcgcgggttaatgtaaatatttaataactttctttaccaactttagtagctagttgaattacatgtacaacctaagtctatttagataagttttttcttaaatatttataagaaaagagaatacagtgaaatgatttgaagtacactactaaggtaaaataatttgatctcaacttatgacttctatagtttttattattatttaacttcttcaaaacgttgattttagtttgtaaaaaaagttaaatgtattttctttttattttatttttcttattaaatacttattgaaaatggtcctacttcaaacaaggaaatgagtggctgagaaagaaaaaaaactcaatctgcctataccttcaaccactccaggaatttgaacggaggaagagaggggccaggggaaaaatcccttgttcggttgttcctaacaactcaaccctcctttatctttgaccgtcacccattactttctccactatactctagttttaataatctttttgaaacagtgggggaacaattttagtttgcttcgtagtttttttttttttaatttttattgtttatctctacttttttttagaaatttatctccacttcagataaagcagttatcttttgatttttggtttaaattcgttggttatgatcccatgatccattcacaattgatgattataaatcttgctagtctaataatgtatttttgttgatccatcctaagtgctagcttgctataattattatttttcaggtaattaaattgatggattaataaatatcagtataaataaatatcttaaaaaaattaaaggaaaaatctctaaggattaacaccaaaaaatttatagggtgccaatggttagttatttaatttctcacctctactagaaataacttaaacttttagtataaatatatatatatatatatatatatatattttgtaagtctgtgctaacattataattattattaatgtgtcgtagtctagcaatgtaatatatgtatggtatatatcaattttctacaccactagaagaatcaattaatatataaggcatcattagtataaatttagagtatttatatatatttacaagtttattttcatcaaacaaaatttatattaacaaagacaagcttgaaaaaccaacaagataattaatgaactaatattttttgtggtgagtaccaatatgtcattatgttttcaataaattatattatttttctttataattactactatttccctaacattagggtgcggcgctctgccattgttcattataaagttgtttttaatttacctttaaacatgtaatctgttgtttacaacaaaaattgtggatttctttgttaaattaaaaaaagttgttgaacaaagtttataatttgaaggttttaattattaattttttttgttgtggtttctttctccacagtacaaattttatcttccaaagaataatatagtttccattacgccatatttgtttcctattttttatgaataaaagagaggattttgtttatgaaagtatactagaggtacttcaacccagcatctagagggaaacacctattacattaagtaatacaataacgagatccttcaattttacggtctatctaggattcattttaaataaaatatcatttttttatcagcaaatattcattgttagaatgttaattttattaacagaaaaaaattgaatccaccatctttctcttatttcctctccattaaccatccaactcatattaaatctccaaaatttcatttctttgaatttatattgaccgctgtgtcaccgactaaattgatctccgaacactttccaagctgttggcgcctttgcatgtaatatatataacttgtataatgtggttcacagtgtataagtctacaagagaagaagaataactaaagccaatgcatatataataagtataacgtggttcaaaatgtaaaagagaagaataaataagccactgcaagaataagttaaggatcacgcgcgccttatcaaacaatttcgtcaaaaagagggaggtacatatcattctcacgtttttttttattgttccaatattccttaataaagattgattaaagatgaattcctctttgatattaatgcatatatcatacattatataatataatgtgtatacatgattaaatcgattcaggtatatatataattcaaatttccttcacgctttaggtgtttattttggaatctttagattaaatcagcagtcgaagaagcttcgcatttttggctgccaagttgtatcgattgcacgaaaatatcacacatcaaagtgtgggtaacaatgtaacatcatataattataatatgggaccctgaaaaaaaagtttactaactactttgccaacactttgacaaaatcatggctagccggcgcaagtcactggttcaaagaaaaacgaagcaggtttatgaattgattaatcaaattacaaaccaaaagtaaacaactccatgcattgacaacttctttgctagttctgcgtgttaggttaggtaacggaagagagacaaagcaccttgagatttaatctcacattacctaattaaccttgcgagtggactagtggccatataaatatgtgacatatgcacgcacttaggaaacacatattctcatcacatagagttaattacttacttggagggttttagagaaatggcttcgtcttgttctagctttatgatcactttggcccttttggtcctcgtgttggggactaatactagtagtgccaatgccaatccaacacttcagacaaacttctactacagttcttgcccaaaactttttgacactgtgaaacgcacagtggaatcggccatatcaaaggagacccgcatgggtgcttctctcctacgtttgttcttccacgattgctttgttaatgtacgtaatttttttaacatttcttaattaaacactcttctttctttcaattctgtttagtcctagaagttaacattttaaattttgccttcttgtttctttccccaacattttttactttacatttgatttgagttagatacgttatgggtcagtttgtttaaatttattttttgaaataagtatttattttaataaaataagtcatttttatttatttttttatgtttgtttaaattattcttcctttaaaaaattaatttttattcattttaagaaacaaatctcatctgtttcctaaaataatacttatttttaaattatttttttaaatttaatcaaactcacctctaactaactgattttacataaaaacaaacttttgtagctagtttttgcaattacattttgtacaactcttgtactaagttactaaagtaaccccatttattatagttcatatcaatggtggttattcatgatcagtgtaatttatgtccaatagtaattttacttttgttcaactttgttgatacatatatagaaagattggataaataaatattatatatgttgcaggggtgtgatgggtcgattctacttgatgacacatcaagcttcaccggagagaagaacgagggacctaacaggaattctgcccgtggatttgaagtgatcgaccaaatcaaagcagctgtggagaaagtgtgtccgggtgtggtttcttgcgctgacattcttgccatcgctgccagagactctgttgagatcgtaagcaattatttatttgaatgtcattgcatatagtttaatacttttttggggtacatatatagtttaatactttaatcatgcatatatatgtatatattttaaaaaacagagtatctgcatggcaattatttgctgtataaggaagtagaagaaaagaaaaagaatgtaaaaaatgtttaagatattcctgataaataattttatataagacaaatcctttttgaaaagacatccacactaacctcgacaaatgtgattaaaatttcagttttctatttgtttctctatcacttggagaaaacagttattgtcattttcattctttgccttttctttttcttccattttcacaccaatctaaacaaaggaaaatttagcttgcgcgtttcctttgtacatgaatcaatctccacttctccattctgcacacacatcacaaacatatgcaagtatacgtaaactgaatttttaatttgttgaatttgatcagcttggaggcccaacttgggatgtgaaacttggaagaagagactctaggacggcaagccaatctgctgccaacaatggcatcccaagacccaattcaaacctcaaccaacttatttccagatttaacactctcggattttccactaaagacttggttgcactatctggtattattatacaagagtctaatatcatgctctcttaacacattaattttaacacactgtgaatatgattaaaaattacaaaatgagttcctcttggtactttttaattaacttgttaccatagcaacaatcatttactctttttttttttttttttaatttcattccactgcatattctagggggtcacacaattggacaagcaaggtgcacaacctttagagcccgaatctacaacgagaccaacatagatagctcttttgcccgcatgagacaatctaggtgtccccgaaccacagggtcaggggacaacaaccttgcacccattgactttgccactcccactttctttgacaaccactacttcaataacctcattcagaagaagggtctcatccattccgaccaagaacttttcaatggtggttccactgactccatagtgcttacctacagcaccaacccggcctcctttttcgccgatttctccgccgccatgatcaggatgggagacattagtcccctcactggctccctcggagaaataagggagaactgcaggagggtcaactaattgaattcttaagagagctacacataatttggatatcaatgcatgtgtgtgtaataagttgttaaacgagagttttgatttcatttctatgttgtgactttgtgtgctaccaagtgtacgtacctgcattgttctatttcaattcgttaatttaatttgcttgtaagtggcgatgttgaggttgaaggccttcgatgtacaagttcctttctgacttaatttccttttacaattataattaattattattacactcccatttttattttattttttgctttttatgtcaatttaatttctagcttacttttcatatttgttaccaaacttttattctgacgtacgcaaataattcatgtgaaattccatttttaacatctcatctaattcttttagtagctttttcaatgactcttttcatctacgaatgacaaattatgaaatgtgaactgaaatcacgacatctcaaacattttttagggtctaattgccagctaattaatgttctttgttgaggatagtcctcattgcttactgtcaaaatgtgcaggctaaatataatactcctggatttatatataagtaaaaaatattgttagatttaaatataaataaatttaactaattttatctcatttagtgctattatttttaaaatatcattcttttaattataattctattattaatgattcatcttataataaattttaatgaaacacattttaaaaataactatatttttaacttgaaattaagaaaattaaatgattttaactaattttttaattagtgtgaaattaattatttttacttatgagtttagaggaaatacatgattagaaagttatatgaggcacgaaataaaaggcataggtgaaggaactagctattgattttactattattttattaagtttggctaatcaatatttttaggatattagttaagaaattaatataagaatctaaggagtaattaatgacaatgaatcgcgtcacctaaccagatagatttttccctactcttacttcaaaccatatcgatctaaaagaacaagtaccatgtattctaaacgttgttgtcttaatttttgttatgtcataacactttcctatttgagctaatccattctatttttgtcgcttcacctccttctcaaaagcttttcatgacttcgtttattatttaggtgtttgtttccattatttttctagttttaattggcactaaacatacaatttggtgcctcgttaaaacattgaactttaaattaattttcacaacaaagaaatatactccgatcatctcttttgtccgcactgtcaatataagcaataattttttttcacaatcaaatacacgagattgatatttattggatcattgcacgtattttttttttctcttgatttgtttccggaaattactttctgcacgtctctaattgcttccagtacctattctgaaatgtaaaattacatttcggaatagtcaatgtaaaaatttatcttctgataagattatttcaaaaatatatttttacattttcaaaatagatgttccagaagttcaaaaaggtacgtacagggaaaaacattgaaggtgaaggaagcaattatctttgttttgggtcaatggagcaagtgctcatttgatatctaagaaccgaaaaggaaattgacattggccctccaaaattgtttttgggctttacctgcaaataccaaaatgtctttttgattctttcctcccatattggcatccacctatcctttcaggcaaaccaaataatcacgtttttaaggtgttatagttattttactaaattgtgacaaaaagaaatcatgattctggctagccgtcactcccattcaggcactgccgggatagactgaatcaggtagcagttactttgtataataatttttgcagtagattaatactttcgttgtgcttttttttttcagaaaaaacatgtacaacaaacagaaatttgattttgttgtacattgtgaatgaactcatatttctatatacttttttaattgattcacaacgaaatcataatttcattaaacactttttttacataccaagctatacaacaaaaatatacttatgttaaactaatgagaatgaaaaaaaagagtataatagaatcataattacattatatacataatcaaattacgatttcattgtataatatttttcacatcccaataatatagtgaaagtgtgctttcattgggcattatgagaaatgacatttttagattttgagaatcttggtagggccaatagcaaagcaacccacaaccaaagatatcaatacgcgcattttgaccattggacaatgcatgtttggagagtatgattaaacaaatatgagtgggcctgagttcatagatacccatattttggttctatttgggctttcttcagtccaaatttttggttttgtcgttgagtatttgttaggattaatgacgaaacaaaatgcattatgattttgtttttaagcgaaacaagattaatttgattaatcctatcatgatgttatcttcgtctttagcttttgaggggaattagatgctctctcctgaagcctttctatcataatgtttttgagagtcgttaaattcatgggtaaattatatttttaagtttcttattttttgtcaaaattgattttgatttgaaaaccataatttttatgctcatattttttataattaataaattttatttctctttatggaatttaagatattagggtgagaaacaaaatttatcaattataaaatatatgaagataatggtcatttttaaagtataagaactaaaatcgattttagaaggaaatcgagagatgtaaaatacttttttttctaaatttatttatttagggcttttgtggtcagatccaattcttatttgacccaaaaagcataataagttagtaacagttagatacagatgcatttgatgtaaattaaaaaacaacacaaataaaataaagcaagcactaagtgattgagataggtgaaaaatttaaacgaacaaaataacatcttgagtaacttggccctctctctcatacaccagtcaattcctaggaaaaggaagggatttggcaaaaatggaggattagattggaaatgcataattgtaaaactcggtttggttattgatccggttgaaatagtgagtcaacagtttaatcggtgaatcaataatagacctgatttgatccagtatatattaaaaattcaaaattatatatgtatctataatatataagaatataactaatattatttgagtaaaaaaagtccattcatactctaaaatccaaaataacaattaatgataatccaaaatctaaatttaaaaaaaaaaatccatttttttaaaaattcaaattgtttttaaaaaaatttataaaatcgacaattgagtttgactgaatctctttggattaactgcataaccgatccgaataggtcatcggatccaaatccaatcgaccggatcagatgagatttcacaacactgaggaaaggcctatcaatgaaaaaggcatcaatttaggataatgatagtccaataaaagaattctttttatataaaaaaaaaaatcgaattaagatagagtctcaatattacttctttagttttgtgtttattgtggaaacgggccgaagtgatgataaaatagtggagaaggaccttgagatcgcacagaacttatacaatgttagaagttcaagccaataatatatcaaacttaaaaagcgtgttgtgcatgaattttaaagggaagtataagttagcttaaattgaataaaaatttcaagctgtatgtagccaaaacagaattatctcatgttcaaattccaaatttactcaccttgcgtcatgttgtgttttgctagctgtagttattttttaacttcccttctgtatcaccaaaaataaaataaaatagaactgtactcatctctaattattattttgatatggtagttataactccaattagacatttaggcgcatgtataaattggccacttgaatatctagatttgctataattaactaattagaagatttaactatactcaagtatattatattaaaaaaaaaaaggcttctaatttaaagcatatacaatctcaacctaaatcatgagataggaaattattatttccaacacatttaaaccccacacacaataaccaaccaaacaactacattttcaaagattttccacaatatgtaaattaaccgtgtagaaaattaagtccgaattatgttacctccacaaactagactgctccatggctcacaattgcattctttatgtttccaaagggatagaagcctctaaaaccatttgaagctttgtgtttgagaaaagagcgaacagttgtagagcgtgagaaagagatgcttccttgatctgtgtccctcaaggaatatgagtatgttggataaaccaatgaccatgatgaggatgaggatgaggaagatgagcgagatgatgttggtgacacatgagcctttcttgaccctataaactttggcataaaacatgaaaatatattggcctttgagtttcttctcttgtttttggaattcaaattggaacaatatgaaggtgggggtgtaaggggtggcagagaagtctcagaagaagggtgttttggggtgccaggttgtgcctcccacatgaaaggaactgcaattgatgtttctccataatagaagatccttgaagaagagttagccatggaggtttccttggacattagtcttgagaagaacctatcatcctcttttattctgaaggacttctcaattgagacatgattggcagcaccatcattgagcattttggatattgaagtctatgattattttttatctcaactacgatctataatatgcctcatacaacaaggtgtgtagtacactcttatatttgctatctagactttagcattgttttagaacttccccgtacttaattctcttaagagttaaaacgaataaatataataaaggttgcatgttcttctaaaattactgaagaattgggttacttcgaatgggaattgatttaagcatagggatttaatcaaggagggcccgggctgttcgatcaatttaataattgggattttttggagggcaccaatttagttgtggcgagatttaatgcatgatatagatagttggtaattaaactatgaaattgaatgggttattagtggcagttgctcaattatttatggaagaatctggaccattgactaaagtagcgaaggtagttcctttataaacaattggtgctcagaaacggttgaggggaaggggaatttggttacgggggaacactgtaataaatgaaaacatgtcgtgatcatgaatgagaaaggagaaatttgtagatatatatatatatatatatatatatatatatatattacatactagtactgtataattgctttcctaaataaagagttattacctacctaattgaaataccatatgctagaaatctaatactcattcattattcgtgcacaatttaagtaacatcgatcaacagggttagtgtgaaaggtctcaaagtccattttcaacttgggaacatgagaagttctacatgatcaaggaatcgaattacatggcatactaataaggttggatccttaaaagagattaattaatttctcataatgtaccgaattagggtttgaatttttttacaggagagatacctatattttatgtctgagcatgccttaaaaaattgtctttaaaggaggatatttatgaagaagaaaaaagaaaaagaaaaacgaacccaatgacatcaaggacaccaaaattaatcaattcatgccacgtgaattattatctgattggcaacgtttatctcttctaaccaaataaatgaataaataaacccatctaattatctgttgctagtacaatttgttaggtatagtttgagaggcctgcattttgcacatgatcttctcctaccaaactttattttgtacccaagcttggatatattggatgctgaaagttcatcctcattaaatagcaggaagaaattaatgaatacgttgacctactcgggcatcgcgtatagagacatatcagacagtacgtaacagtgtcaagggtattagcattatttattagccatgaaatgtcacatatgggatgagctgtgcgatcagaaaagtcctatgctttttcattggagaattgcacccacatgtggataccgttaactggatctttcctacacgttttgctcagtcttaagttctctcaacaaatttgattatttgatcaacccacccataccagcatgttttaaaaatggagtctaatttaagataaatatttctgcaccagatgaaaatttgttcattatcaaccgtgcacctcactaattagatatgctgtgcgacgtgtaataaaataattaaaaaatggcccattactataaagagaaattaccattatatatcacagcggtgaattatcaacagcatgcaggaccatgcatgcaatggtccagtactggaaaaagaatttgatgcaggagtttccgaaatctactgtgagtaagatacattgaatggtcaaataataacatattagacgacatcaagctaagcattaattatgtatctattaggacttaaatgtgttgttcactaaatctgaaagttatgattaattgacactactccactcaaggatgccatgttgagatgcggaatatttacgttaggacctcttaatcatgtgtttctttctatatatattgcactttaaataacagaattcacttgttatattactgccattgctatgctgagggggcagattcgttacgctccatgtgggtgctaaacaacttcattctgatatgaaatttgcttttgatttgttcatttatcacgaagaatgatttgaattagacattgcaacagaaaaagctgggattaggtttggagatattgaaaaaataagtatcttatttgagagaataaattatccaagtatcacatttaacttttaaatataatattaattattttttttctatcaatatccctaataaatattattttaattttgaatataatattaatattattctcttttgtctatttaaaaggttagttttataaaaatatcaatctcttacatctatttattaatttttttatatgtgagatcaagaaaattaatgtggctagaacctactgttattctttttttaattaattcaatttatggatatatttttaaataaattatatatatatatatatatatatatatatatataaannnnnnnnnnnnnnnnnnnnnnnnnnnnnnnnnnnnnnnnnnnnnnnnnnaaaaaaaaatgaaaagctaaatcgtataaaaatatgttattacaactttattatttgactttattataattaaatattaattattacaataattaatttgtatatttggtaatcatgaaaactctctgtatgagtaggaaagagtataaaaaaaagtctatttgtgtgtgtgtgacaaagaaattataaaaacaaaattacatttatgtgtttgtaattgatgtgtaacattttatatcatataggtttgtatgcattttgggtttattagtagttttatcattgttttcttagtttccctagtttaggtacttggaactcttgaggtgtatttttatatgtttcagggaggtttggccttggaacttaaggatctaggcttggagtgattcagaactaagagaaggacaattgggagcttggaaacttgaagaaaattggagaaatgacaaccaaaaggtgccacacccaaggtgtggcaagcatcatatcagaaagattaaattggcaaccataacccacaacggctacggagtgagaatttccacggtcatggcatgctctaagacaacatgacattggttcaatattattacgatataatgagttgtaggtatcagaacaacgggagactaattcctaaattttaagcacaaaattatttacaaccttaatgacgaatttcatgtcttgattgtgattttggtcatgcaagtgaaacctgctacaacactatttcgcatttggtttttgtattataattgtaatgggccttgaaccctttttggaccttaagtttgatagatattttagagcttgctttagtaattaagagtctccaactttaatcctagggaagaaatgacaacacaatgatcaagattgaaaataattcatatttgtgacttctctttaatttaatataattgagttctttctttaatttcaaattgattattttctcacttttgatattattaatttgaattccttttagaaaattgaattttgggttaagatatgtagttgcaaatcatttgttcttaatttagggataaaaatcttgaatatgtgatctgtatatgagttcttgaatttaaagtttattatgaattcaacttgtgtaagaaattagagttttggtcaaagataagactataagaggattctttatcatagggttgagattaatattaatctagttgtgtaaacataaatgtcaattgcctaagattaaaaaaattctaaattaattaagttgtattggagaagattaaaaaagtttcaagataaatgctaatgatatattctctaatacattattggccaaaattaaataataaaatctattaaaaactatgaattttggtgaatttcataatagaagtatcaataatagactctttctatcacaacaaaatcttttctacatgcatgaccaaaaaattaaactcctctcaacatacttaattaaggagttcaattatccttgccttttgtttttaaagacgagtagttaataattttccccttttttatttctttcttccctcttgtgtaaacaaagaaagaagagacttattttattagtgtacacaatgctcgaataacattattcatttattctaaagtttaaggattcattaatcttcattaaataagtttcgttctttttctttttgcttgaggcggaactctggcaattggcaaaggttgtaaagatcattgcagacccacccagccgtctccagacagcggcacgcagtaatacgtcgtcgtttccatgcataaaaatcgaaaacctaaaaacatggttttgccttttttccctgaccactaatcacgccccaaatcatgacaaatctttttttaaatttttttaatcatactattgatataatcatataaagttatgtttatcaaagacattaacagatcttcatcataatcataaatacagataaatgcattttgtataataaaattaatttcatatttaaaaatcaatcaaaatttgaattttaataatttaattaaaaaacagaatactgaaaaatatatctgtgagagtgaagtcaaatacgtcgctacttattgtgtgaaccatttagggcaaatcacgacaaatcttacagaaaccacaatttcaccctcaccaaaaccatctgacgtggcaccacctcattggccacacttaaaaacacgtaaccacaacctttgacttttctccctcaccaaccaacgacaccatagcccacaccgtaactccacgtcaccatccccacccaatcatccacccccagaagcgctttccgccaccgctatcccccttttctttttttctcttttctgctttcccctttcgctcgtcgtgtggccccgcgacaccatcatcacgcacccttcctccttccttcatcctcggtattgcaataaatcacacaaatgggtgcttcaaaaaagtcaaagctcgaacctttatgttgctttagctctcgatgcttctctgaaacccgcgttcgcgttgctctttgcgccaatggccgagtcgtccccgccagaaacaccggaaccgaaacccgagttcggtacgggaaccgggtcgggtcaaaacctgggaatgaggagagtgggttcgagggctgaaattgacacttcgccgccgtttgggtctgtcaaggaagcggtgacccgttttgaaaaaaccggaccttgtatacctcttttcaattttggagaggcttatgtaaattttcatctctctgtgttttgtttctaattaattgttcaatttttaagttatgaatgtgtttcgtgtttctagtgttatctattatttaccttttacttgataattggttagatacatacaaacgttgaataaaaatgaattttcaagtaattgagcaatgccgcaattctgagaaggaacttgattactgagcggctttatttttaaaaaaagaaatatttttgcataagagctgcaaaaatgtttccttttctgagcctctcagacactccttgcattcagttcaaacatatgtagctcttgatttgtgaaattatgcccgtggtgatttactctctgatgttgaagattgtttgttaacagaaaagtgctgaagactttgacataaagagagtggaggaggaagcggcgaagttggaaaaggatttgatagtgaaagaactcgaaacacttgacgtgcttgaagaactgggagctaccaaagcaattttggaggaattaaagcagcagctacaatcagaagcgttgaataattttgcaactccgggtgggaattcatgtgaacaggttggagctgctgttcaaaactgtttgaatggtatcaataatgaagaccagtcgttgcaatgtctgagtccgtgtgctacttcatcccctgatatgttcatgatggagttaagacaagctaaaataagccttggtaaaactataagtgatctcggggtgatacagtcttctattgaagctttgaataagaagatgaagaaggagaggctttttgttgagaggacgcgtgagaagcttgcatcgaagtttgcaactgtatctgctcaagaagtggccaagaaagaaacaaggtttaatcctcctgaagctactgtaggaacaggttgcacttgtcattatcccctaaatgttgcgaggagtttcaaatttgatactggacagtgcaatctaatgagtgaaacaagaagctctgaagtttcaaggccattgcctgagtttggagagaatggatttagtatcaagactgctgagatgaggtggtttgcagctaagaagatggaagaagctgcaatggcagcagaagccgttgctcttgccgaaattgaggctctatgtagccccgagatatcatcggaattttctcctccacaacatcagaaagtgccatttgccttaggggagcgctctcctctgcaccccgtagttcaaattcctcaacagtcaaccttggagaaggtgatagattccaagtcccaagttgataaaataggttcttctaaactgagtattttgaaaatattggaggaagcaatagaagaagttacacgcagcaaacaagtctcaactgaggcattaaacagtgttgaaagtgcaaacagaaagcaacatgctgctgaagaggcacttcggagatggattcctcaggatgatctaagaggtccgccagtgtacaactatattaagcccaagaagttcaatcaagttggaaatggtcaagattctcctctaccagatttaaccaggtcgattacagtgaacaatgatcagaagccgatcttaaagtcttcagtttcaatgagagatgtacttagcaaaaagcaagttcctgaagaatatacaactaaggagatggaagagcactctgaaagaaaggtagcattgagtcaaatgcttcgagcattgaggcaggatcaaactctgcctacaataccagagaaagatgggagcaatcaaagacagaggaaaaagtttggattcatccaaatatcactccccttgggaaagcgaagtaagaaaaaggcatgaatttagtcctattgcctatgcatggatcaatttccacaattcatgcatcagtgtcttgccattctttattgattcttatgttttgtctgcttttttgttaagtcatacagaatttatgactgattttgtaaaatacttatctagtgagataaggctattgttgtgattgtttggttttgtaaacttagtttttcctgtgtgattgctcactttatgcaactggcttagctttaacgggactagtagattttactgttgtgatatatatatatatatatatatatatatatatatatatatatatatatatatatatatagtcacttacaatacactacacatgtcttgtattatcgggtaattttcaaggttctaccgttgacacggcgatggcgaaagtgagtgctctgttgcaaacaattggatttggttgttgatttcccttatctttcatttggccccaacaaccatttccccctttgaaggggcaaatcctcaacacacacccaaactttccaactccaaacatgtccatgttccgcttcatctccacaattgatgcagcatacgcggtaaaactggtcaacaactcgttgattctagaaaatattgagaggttgatgcatgaggaaacctcactacttcatttcattccaatctgctaagaatacatagaattagtccatatataggcaaagtaaacctaaataaggattaatcatcctaatttttctaattaaataaggatcatatctttctaattttcctaattagataaggattatatcttcccaattttccaaaattagaaacaacaaaatatagaaaattcttaaaataaaacaataaatattcctagaattacataaaagatgtcattttaacccccaaagggatttggcaaaaatcttgtggcatgctctacatcaacaatgctaccatctaccaatgtttcttactccactccaccccacaacatcaagttccattttttcctccgaaggcaacaaccagttatctgaggtccaaacatgaatatacatggactgcgtatactggctgcagatatgctccccttagattgatgctagagcccttatcaagaatatttcaaaggatttagcttctctaaagtgaaaagtgacgaagtaagaatacaatatatttatccttgatttgaattaaaatattttaactaactttgaattagtggaatataaacccttatgttttcactctaaacctataaccctgcatatcgagctcctttgtaattaggcaagggagtctttggttttaggtagtcattttgttatatcataattataaatgggaataagctaggcagacaacacaggtatgagacttggcctgtttaaaatctgatttgaccgggtactttttaataaaaaggatgtttaaattttttaaaagatctatttaattaaataggctagacttaaacttataaaaaaaaacatttatttattcatttatttataataaaaaattaatattataatattatatttttatatttaatatcttaataaattaataatcttatatcgtaaataaaataaatatttgagataaaaaaaattttgagtagactaataagttagatcaaactttttaaaaaagtcaaatcaaacctaaattttgttttttttgataaactaataaatcatattaaaccttaatttttttaaagtaggttagacgtatttttttataacaggttagacgtatttagcaaagtctaacctgacttattctcaccccctaatcatacgtaaaaggcaaccttctcctatcacaatatcaaggagatcagatgtttggctgagttcggctattaactcattgtagaagcaacaaaataccatacataaggttttcaaatgaaagaactgaattgcttccattaaaaaatatttttagcttagttctgaaaattccgtcatacattgaaaattttaaaattttctattaaaatatattggattttaagttcatattaatttatttttgtttacgtataaatattttatattaaaatttaaattaacataaaattatcatgaaattattttttattttttggagagagaaaaaccccaacttgcacaaatcttctctgcacaaatccttcacagactgatgcatgtttcggatctacttcggactgtgaagttgtaaagataaaatttgtgagtatctttattcattttcttccaatccacatcatcaactatcctagctaatgagcttatcacacatactacatgttgtttataaaatataaccacacaactactcgaatttgttagtggcgaaaatgatatcaagtatatgattttacaagatgaaggattgagattcaatgcaaagttaaggacacagacaaattgtcgccaaactattatctcaaaatgatattatttagttgtaaaatattattaaacaataagagtttattttggtacatatttgctattggtaagattttgataattggtacaagcaaaggtcgaaggcatcaaatcattaacctgagcaaaatctgtcatctcaaatgcctatatctcaagaaagatagctcacttcaacccaaagagatatctttgccaaagagattgctgattccctttccaggatcactttgttttacaatagactccccaaccaatatctacaaaaaagaaaagagtaaaataatgagtctgataagagtaaaataatgtgaaacacctgttgattgttggtttactataagtgttggaaaatttgctaaatatgatcaacatgtaacaaatgttagatagttgtcataacctgagtaatccccttatctaacgaaattcaaccgttcttttactcaaactattattaaaattgcaataaacatgattgcaaggatatggtagcatatgatgagtaatttggctgacaccactatattttgtataatattttagtaactccaaaaaatcctgttagtaccttggttgcttttaaattttgttaaaaccgcatggccatgtcagattttatgtgaccgactcaaatacaagggatttagaattgtcattggagctgcttaggattaggaaaaaattgagtatttcaattaccatttcccaggtgtttacttagagtagaaatgaaatttaaagacttacagctttaacaccagcttcttgaacataggcaatatcgtcgggggtgaagagaccagattccccaaccatctaaacaaaccatataatcatcagcatgatgttgatattcaaaataaattaatatttctttcaagtagctctaaacaaaggaaaagccacatacaattatgcctctctcgtggattattttgcctcgctctccttcaagaagcttctttgtgatgctgatatccaactcaaatgtttctgcaatccccaaaaagaaaagccacaattgatgagtcatgagtcatgagtcaaatcctcaagttaaatattcagacattggcacaaaagataaaaaaaatgacgtagaaaattattaatattctcaaactcgtgtgcgcatgagataggaggaaaaaaaggcccttaattgcactcttggtccctttactttggattatgcacaattttgctcccttaaattgttccagccaattaagtccttctaggagttatatcaatttccttctacctaaaacccttaaattctaattttctagttgaaatattcacaaattgaattaattaatttttttaaaactttcttcaaatcaagataaaacattaaatttcacccaacatttaaaaaaaaaaaaaaatcatttccccctctatttgaaccctaatttcacatcctacaaaatcctttaaagttcaactaaattttttacttttaaatatttaaaaatatttaatattctaaatccatcctaaacccacaagtatttagaaaaatgagaatttgaaggtttttagatataagaaaattgacagatggacaaaatttgcttgattttaaaaatagaggaacttaatttgcttaaaaataacttcggggattaaaatcccacaaatttcaaaataaaaagaccaaatgtacaattaagcaaaaaaaaaaaatgttgcagagggaagcaatagcataaagtataacaaataaaaataattgtattacttcaaagttttatgagttctaacttctaagagattgttgtaataaggtacaaataggatttgagaattaatgaagaaacaggaatatacagaaaatgaaagcaaaaatagaaataaaaggcacataaaattggagacgtaccggaaaacatcaaaaagaaaaaagtggaaggggagacaaagagaggagtgacaagacataccaagattacggttgttaatgccaataagctctatgccctctattgcaagaacacgatcaaattccctctcatcatgaacctgtgagtaaggaacataaaatgtaaaaaaaatctcatgttcatcaggaaataaaagactctgcatggtagacctagaattatggtgtaagcacaaataaggaacataacatagagattcgtctagtcaatctaaagattttatacttttaaatctaacacacttcaattcttgctttcatgtacagaatcattatattaaagaggttctcagtttgtacattgcactattcaaaactcaaagtgacccactttaggaccaagtttacacaaaataggataaactcaaaacatagcgcaggactagattcatattaaacatcagatatcagtaaacttaaaaagatttgttaatgttgaagttgaatgtcattcaaatttaggaaacaaacaaaaaaagcaccaatggtacctcaacaagtgcagtcattccgagtaatttgcatatcttaatcatgcatttgatgtcaagatcaggcaaaacagcagcaattaaaaggactgcatctgcacctttagttcgagcatagtagagttgccatgcatctatgatgaattctttgcacaacaaagggcactgcatattcacaaaacatttgatggtataataaatccaatatcagggactatgcaattcacaaaacaaacctttatgccagcctttcttattgcctcaagattttcaaagcttccctggaccaatatcaagttagagttaattttgttgcaatatcacctagtactgaatcagccaaatattatctagcagtacacatgtaacaaattccaggattgttggtttaccttaaaatacttttcatctgtcaaaacacttagacatgctgctccacctttctcataagccttagcaatttcaacctatcacagaaacctctaaaattgtggcttataccatgaagagaagaaaaatacaaactaacaacagtgtcaaataagttgcttgaagggcacaatatattgactgatacaacaaaaccaagagaccaagatactcaatgagaaaacataacatattcctgactgatacaataaattcagagcaggtccttatttacagaagataaaatttaaaaactataggattgacttcataaatgcaataattgtaaaagcgaacagagagcctatgatagatttgagatgaagtaatttatgttgatgggcatgcatctcaaaggggtagaaaattaattcaaagaagcaaaaagcttaagatacaaaggagaagaaattgataagcatcataaaacaatttaagatctatctctgcaaacatgactcagatcacgcacttattatataacaagtagattcaggaagccaaatgaaattgaatagactaactttaaccaagtagatgcaatagggtgtcagtcaggaagccaaataaaattgaaatattttttttataagcaaagtaatttattgatataagaatgcttgcaatgagcacaagaggtgcccaaaacaggactcaatacaaaacatgatgctgcataatataaagctcaacagcaagctagcctaaaacagacagatattccccatcccacctaaaggctaaaacacagtccaatgaaagctatacaacctcacgagtaaaactcatgtgtcacaggaattattacaattaaaattagacacatctcacaatttgttgtgtagctataactataagtccacgtatttccacaccaagtcacatgaccttaacagtacccatatagtgtttgttaaaatgccaatataagtaatcccactgacttgatattacaaactcatctgccaacacgttgacgctgcaatctgacattgagctatgctaactaccaatttccatctttccacaccagccatccaaatatttaagccttttttaaataaaaaacactcatctcattgaaacctcccaacaaccaatgcatttcatgacagataattctcccacctctgtgaacaacaacaacatcttcactccaaacaacctccaaccatcaacagcttttacattctattcaccaacacacaatcccccctcaaaccccctaacagtcctaaaatgaaataaaattgtatagactaactctaaccaacaagatgaaatggggggtgtcagccagttcaaacatttcacacattattacatcagaaacacttcataaaattacaaataaagtagatagataacaattgtaatattctatccgtaaaaaagatgtggaaaacaacgcaaacttactggatcaaagtcttctctcaagatacctctacttggtgacgccttcttcacttcagcaatcaaccctggaagtccagttcgttcgttggctgcctttagagcaccaataaaatccctagcaggaggtgcattttcgagagctttcttcagcacaccaaggggttttctttctttaagctgaaaatcacacagtccccaataatacattcaatctatttggttgaaaaacaacatatatattaagaacaatagaacacaaagcaaatcaatcacaatacctgtgagacttctgtgtccttgttccacacaatctcttccaaaatgttccggggcgtattgccctcattctgcaaagggggtccagatggaggccttgtccttattcttataccctggctagctgcaacctcattttggaacattcccacctcccactccttacttttcagaacctctgtcacagattcaccagatgtggctactacagctgaaccatcattggactccacctaatcaaaacgccacataatccaaaacccacatgaaaaatcaacacgcagttcctcatagcataaaattctgcattcatacacccccaattgaacccaaattatttggcctatttccattatcactgaaccccaacaactcccaaaacaaaaaccgagagacccatattaatccgtaagaagacacgataaaaggttgcaaaaagatacaaaatttgcaaccaaaaaaaaaaaaatctcacctgggcacgaacagaaaaggatgaaaaggagcttcttttatgaaaacttgcttgggatggaagaatagaggttctgggtctggaagagaggaatggggtggcctgaaagggagccttgagagaagccaaaccttccattgaagcagattgaagggaaaaaaaatggaagggattgcgcagcaacagaaaagaaagatgaaacggaaagtgaaaccagggtttaaaagaagaacacaccgtctaatcgtccatgttatagtactagtattgaattgaattggagaagaaaatcgtcgtagcgttcgacacgtgcgccgcgcattcaattccgacgccacggcgtgttcgtggtttttctggccccaagagagtgtaccggttgggattggattggcacatgtgaagagctaaaaatggcacaaaattaaaattgattttggtctgtgccttttttttctttttcaccgcgaagtatttaactatttatcgttttacagtatgactttgcctctcttgtatccaatgttttgctatgcaggcttggatcaaccgaactttaagttatgttaataaaaggtcttagtttgaatcttggacatgcgtattttcattaaaattgattatttctacctatcatgtaaaatatgggtggacttttctagtttaatatattcatgcatacaattattttgtatctagtgtggaagagacaataaatgtattaaataaaataattaatgttttcatttttataattaatgtttaatgcttttgtttttaggtgattttttgttacattagcatattttttggtacacgtttttatgtgattaatactgcttaaaattaatattgcatatagaaaaatatgaattataatattattagctgttgcatataatgaaaaaggaaatgtcagattgtcgcacaggtttttataaaattgttttgtaagaattagtatgtacctttgaatggattttatttatttatttgactggacctttgaatggattattactctatattattttaaccaatgagcatatattctatcaaattttctgatagtgttactttgtgagatgtgagttgatcatatctgacaaacaaaggtgacatttgtaaaattctaaattcctaatattattagtgttatacaatgagaagacaaaaataattatataatattaaatggaattaatgtataattagtttgagtaaaactgaattgagatttttaaataaaatttaaggtttaaatcttatgaataaaaaaaatatgattgaaagattaaattcaataaaggcaaaaataaatgattaacaaattcattaaattcttcacacggatgtattggttacaaaaaatacaacattaaatgaaatattaatattcaaataattaacattctttaaaatgtgggtttatttgaaactaagaaaaaaataattaggttataatataaattttttaattgtgattcaatcataaatggacatatttgataatattattgatttatattaattatttaaaaaaaatatttaaagttttttttaatttattgataacgtaaaagtaaaagtaataatagaaattataactatgctagaaaataactttttatactttcataaaatattatttttttcacctctcaacatgagaataaaaataatgtaaaatattatataattaccttgtgaaattcttcaatatccgggaattataagggtataaaaataagttgatcaaatatattttaaaatatacaaatgaaatatgttactcaacatattgaatcacaaagaaaagtttattaacattatataacaaacttgcaatatcaagaaaagttataaataaccctgtataaactttagctataggtagtcaatacttctgctctaattttgaaactgtttttctaactacaatcaatagtcccgtgtaagaatgtcacccagtagccgagccacgcaacaattaatcaatttcaacatgcttagattgatcaattctttggctaacaattaaaacaattaggacgacaaaatataccggatcttatggctatttgtaagaatatccacaagtgaaatagataattattcgtaaatttatccagctccgcatattatatatatatatatatatatatatatatatatatatatatatataattttatgtgaaaataattatattttttataactagtactttaagtctctaatttttaataatatcattatcatagtgaaaaacactaaatttttaattagaatttttgttaagagattagaacattaactttaacaattattatgttgaatgattatctttgtaaaattgtttatttatgatttgagtttggatgaactaatattatatttgtttgtttttaatattatgtatgtatgcttttatgttatatttgaattatttgagaatgatttatattataattgtagtaatcattttaattatttttattaatttattattattaatcttatacataagtaaagtataggttgtgagtgcggatatgaatatataaatacccaacgagtatgaaaatggagattaaaattactatccgcatagtataagaccaaataagatattattttaaagggattaaagcttctcatgttatatgagataaatttttctcctatacatcaaaattacttagttttggattaaatttttttcttccttttaataaaaaaaatacaattaaaacagatatttctctcacgcatgtctctcctcttgttgctaaataaaagataatgttcattgattttaggagatgttattgataaaatttgaatataaaattagaaactaacttatccttaacaacaaaataacaattttgacttatttaaattaaaattactttaacagtgtctcaaggcacgaaaaatttaagaaacaactgcactattttcctgttaaatattctagcccctccaaaaaatacagaaaaagaaagaggaaataaaaaaaaaatgttccatatgacataaccgcactacgacccctaatcttcgtaagctctaccataccgtaatagcataaaaaccattgcagcatatacttcctctttcatgctatagatatgttaacaaagccttcatgttgtggtagttggagtctttgtgaacaaaatcctcctattaatttgggcttctattattcataacaaatatagttgtagaaatgagacttctattattcccacactggtgctccgtaaaacatttaatctgtatattgttgttgagatagtgtcttgagatactaattttaatttgaataagtcaaaattattattttgttgttaaggataagttagtttctgattttatattcaaattttattaataacatatcctaaaatcaaggaacattatcttttattcagcaacaaaaggagagacgtgagtgttttgattgtgtttttctttttttattaaaaaaaaaaaatctaacccaaaactacttagttttaatatataggagaaaagcttatctcatgtaacatgaaaaactttaatccctattttaaaacgcaagtatcaaaacaaatactacaaaatcttacttaaaccctactcattgtcatctctaaaaacaatgagaaattttaattgattgaggtttcacaagcacaactttcaccataaccctaacttggtaatttagttgggcattacctctcgcttctcccttttctcctctccttctctcccttttcctcctttaaggttatttccctcccttactttaaatcaaacaatttttgtcacccttccctttctgagttgttagtgaaaattgtccctaataacatccaattttatcccgttgccaatagtgggactcgtaccacttataaatgaatatttccaactaagactaaaaacaattcatttgtacttggtgcattttgcatgcttattatcattataacttgggtttgaattaaaatttcgggattactttttaagaatttgagtaacaaatcaaaccttttaaaatttgaaaaacaatttatttttaagaacttgagaaccaaattaaataatttaaaaattaaattgataattaagcacacaaaaaaaaactttcaaactactgggtacaaatatgatacacctgaagtcaaacttcgaattagtcaaaatcttttttcctaataaactagagaattaagataaaaaaaaggaccaaaataagtaaaccatcccataaagaccaggtgaggggcatcattgaaaattttatctgcagattcttgctaaatgaaataaaacattattctacaaaggagtgcaaaccccacccaccctatatcccttcaactatttttcttttgaaactttaaactcggattcagttcgatggctaataaacatccatcataaggaaattcgaaagcaaagttaacatagaatcgaacaaaactacagtttcaacattgtttttcctccttatcctaaatcaaaacaatgtgtcaaggtctaacagaggataaataaaattttacatctaaagtaagtaacgcttcctgagatgagaaaaaaaaaaaatgaaaacaaaactaagattgagggcatagaatgatctattgacgtgggaactctttctgcctacttttgcttgacaacctgaattcctgaggcgattgtagttcccttcatcctgcagagaaaacaaaggtttatttagttcattcattcagcacactttgatcaagacacaaattccatcaataacacagccaacatttcacaagtcacatcagacaaaatactaaataaaaagagcaatgaattacaaacaaaaaccagattatctataaaagcttttcaaagaatgtataaattccataaaaatgtcctaggcaaaactctcattatagaaagagtgccagccatttcaaaggctcccgataaatttaatctcttacactgttacacaagtaccaatagagtagttcctccccaagatgattgaatatgaaatcatagcaccttattgtcatatatgttcgtttgaaaagaacagcagtagaattcatcttaagaaaaccattttataatgcaatcaatcaactcatctacttattggcatttcatacaaattccatgatttacattaaaagtaataccattcaaaataagcaaaatacaacatagaacataacagagtcagagaacagaaagtcacctgccaattaagactgggaattaacaataagcaagcattatgataagagaaaaactagcaaagttatacaccctaaaaaccaatagagtgatcataaagttcactgaaatatggtgcgcttgatttggcattcaatcacattcaacatcaatgcttcatgagacatagattcacgttgaacattcatcaggaagccagaatcaaagaaaacaaacatactcataaccgcataagaagaaagttaagctgagaatctaccatccattttcaccattccctctaaaggatgatctgataaggacgaaaacaacagacaaaatacaaattgatcttaatttgtacaacagtcagacaaacaaactttcttttctgtcgttaatcaaacaataatctcaagtctcaaccactccaatccatcacacttccttgacacaccataaaatgtattcaaacagatcacccttatttacttacttatttactttcaatttcactgtttataaaatattcaaacaagatgatggtaattttattctgttctacattgatccattacacttcgcttattccataccgttcacacagcatttagatatccaatcaaagccatattcacttcacatcaagtttttaatgttacatgcaatcacgagaaaatgatgctaacagctgaaacaatacttcttcccaagcaatcaaccaaattagccattcaaatgatattttttttataaaaaaaatatgaacacacaaaaaaaaatcgcaatctgtgatttgagcggataataaacagagagatccaagtaaacaaaaagaggaatacagaaaacaattaaaaaaaaagaacatttttgggcgaagtaatataatttacctaaccagatccgacgatgatgttgttaattggaatgaaaataagcttcacgaagaaacccacgaaccccatcacaacgaaaccaattgcggtacgcacggcaaccttggagaattctaaaatacaaaaatgcattggaaaatcaggatctacagcacagagatttgaatcgaagtggaacggaagaaggagaattgggaattagggtttcacctttgcgatcgggtttgtggcagcgcttcacgagcctcacgctgtcctttgcgaattctcttaacggatcgaacacagaatcaatggcgtccattctctttctcttcctcttcctctgtctcccgagcttggatttgagaattgaaatggtcaaatgggtgttgattttttgttgaaagtgttttatttttatatgcgcggagatttttatataatcacaaaacatgtgttgagtttattcatttagaaataattatcgataaataatcatttttatcacggttagaaagttgacaaatttatttttaaagatataaattcaaatttttatatcctaaactaaaaaaagagtgcgacaaattattcattcatttattaatttccgtccattaccaattaataaaagaacttaggtaacacatttagagacgaatttattagattatacttaaaatataatttaatttttatccttttttttaatcattgcaaaacataaacacttaaaaaaaagaaaacaaacaaaagttagaataaacataataataaatataatattgattaataagcataatatttatgttcatttgaaatttttattatgataatattaactagtgacaaaattaagttgagtcttattttttttgtaagtattaacttaatgactatgcattaatttgttagaatctcatattttgggtaaggtgttgtctcatatttttgctttaaaatttctaatgtgaccatatattatctaaaatatgagactcaaacaaaaatgcataattattaagttaatctttaaataaaaaatgagaccaacttgattttgtcactatctaatgttaacaataaactatgtttattaatcaatattatgcttattattatatttgttctaacttatgtttgttttcctaattttttaagtatttattgtaattttatgtttacaatgattaaaaaaggaagaagatgaaaattaaattatattttagatagagcgctgaaaattcatctctaaatgtgtcatgtaagatcttttaattaacggtaataaacgaaagttaacggatgaatgaatttatcgcatttttttcatttccgaagataaaaatttgaatttccatcttttgatgataaatttgtcgacgctatatatattgaaggacgaaaatgattatttatctaataattattttaaaaattatataaaaatagtttataatttttattcattaataatataaaaaaattaagactaatttaatgataagaataaaatatattaatgtgataaaataaaactataataagtttttatcatatatttgttattatatataagaaaaatagtatatgtatttttagtgtaaaatcttttgacattgatgtataataaaatttaatcatttaatcatataaaatgaataattaaaaaatcaatttaaattaaaaaagttaactaacctctcaattttttagcactcttatctgttcaactcattgtctccaaatcctaaattccaattttttgagtcactttcctctatttcactctctctgaaaccaaagtcaacattttttcatgtcacccttcttaattactccactctattcatctcatatttcaacccttcttttttatttttcctaactactcttcattatcttatgtcaaaactcaaaatgctaactactatttttttttcttcaattaccctattctgcttcactcccccattattatcatatatttttttttatctataatgatttgattttcatcgattttcttgattttttgaagttctcttcagtcatgtttacgaatggtagcttcaaatcggtggaatagattttcatcgaatatgttaattatttcgtttcatcgtcctgtgtgagaattagtgtgctccactttgattttatctataagtgagtcactattttattttctctttatgttgaaagttatactttaattaggaaatgggattatttcaattaatgtaattaatctaaattgttatttgattcaattaatctgaatggtacttgataatatattatgaggatatgattattataattaatgatagagcaacattatttcataaatttaaatttaattatattttgatatgagttttcacgtaatattcatgtattttgatatatttttatttgataaaatttctgattttgtgtaagtttatgaaagacgtgtgtttaaatatttcacttaaaaaaaatataaaatcatgccttttatgagataatgaagaccacgacgagcaattattttgtacatgagtgataattttatacatgtgttataatctatactatacaaagtaaaatgttttaaaaaatggaaatctccacgtgacatttctaaagcaactagttttgagtcaaaatgaacttaagggtctaaaataagttttatatataagtccgatgactatggaatttatggacaattagactttagtaatacaaaactataggaaaggtttcttcccaaaaatcatcctatgcaaagagccatgtaatgtcaaagttggccccgttttatcatttcgagtcatttctaagataccttgaatgcataattttggctcttatcatcttgtcttggttttgctagctaacactaactaattggagtatcgtcggcaccaaaacacattgaagctagtaataggaacctataatagtaattactattatgatttaaatatgatttctgttttccttttactattatgaactaggacatgaaagaaaagaaatcaagcacacatgaaactgtagacacgtttaataatttattatcaagaaaactgtacctgatatgaatctggaaattttttatttgagagggttttacctttgaaatccagtccaagcctcaatgccaagcaaagaaaataaaggtccttgcatgaatgaagagtaaaaacatagaagtttaaagaagatcgtgattaactaaaagccagaagtgcaattgtgcaaagtcatagagaactagctaataccaaatacccgaattctcaatggaaaactctaacatttcaaagcataaaaatgcaatttcttctagagaataacacaaaaaaactgaactttctagcaatgtgttgcatacctcccgcaagattgcaaagtttgcaacaaacaaaaggtttctctagggaactccatgcgtgatgatgtcttttgggtgtgagattgacaaaacgaggtgaagataacgacacaatcacaaaatgaagaggttgtgacggagaaatagggacgcacatgagggtttacgggagaaacagggaggtcacgagggtttacgagagagacagtttcagtctcgtacgacagcagccgcgtcggaataagggattaggtgcgacggtgaagcaaagccaacaagttgcagtgacgtagatgtaggggaaaagggtttggagttcagggacgatgagaacataaggagcaagcagaaggaatgaactcgaaaagcatttggtaaaacaaatatagcgtgatttgcaaaaatgttgtacttatgtaaagttactacaacgctttttctaacaagcgaggtaactttttccttttctttttataaaaacatatgcaacatttaaaatatcgatctaaaaatccgttgtatataaaaacctatacaatgtcaatctaaaaaaccgttgtagatgctgttccactctacaatgctttttttggcaaagcaagatatccatgttccgtgtcaatacatataacattttttcataaaatgcggtataattgacgctataaattagaaaatctgacaataaatctatcttatttttcatctcaaaacctcaatcaatctatagttgtgaaattcgatctgatcgttggtccgatctagtcaatgatccaatcgatgagtcattagttgatccgatttgactcgatatatattaaaaatttgaaattatatgtatgtactatatataagtatataactaatattatttgagtaagaaaaattcatccatactccaaaattcaaaataacaattgataataattcaaaatccaaaatctaaaatttaaaaaaaaatccattttaaaaaaaatctatttttttaaaaaaatccattttttaaaaaattaaataaataaaatcagcagagttggactgatccaatcgggatccaataacctaaccagacgggtttgatcggatcatcctggatcaattgtataaacaatccaatactaaaaccaacccaaataaaccaccaagttcaatcagtctgaccaactaaatcagatcgaatttcacaacattatctcaatccttatttttctcagccaccatcctcttcctcacttccctgtctcaaaaccctacctgttattattattattatttttataaagtatgtgtttgatatttgtactttaggtcaaatctaattttagtttatgtaatttaaaatccatcaatatgattcccattggaatcagggaaggcggattccatagttgcctcacagcctgcccattcgagaacatcttctcgatattttaaaaaacaagtgaatttaattcttatttagttgtcaacaacaaaaaattcctatttagtcctccaagttgtcaatgcataaggactaaatatacatataaaaaccaaatcaattatttaaaattaaagaaattaaaatcaaatttaatatctaaaaacatatttttttctgccacttgcactcctctcatcccatctcataaattataggccctgtttggatgtaagtttttctagaacaacttttagaagaagaaagtaagaagaaaaaaaatgaaataagttttttcataagctaaaatgagttttctattagctcatttgtagatattatctcatattttagaaagctatattagtgaatttctaaaaattagttaattgagtgtttatttttgcttatgaaaaaattcatctcatttttttcttcttattttatttttaaaaaatacttctaaagaaacttaccactcatatcctcaactccttgctttttccagccactttccaccgcctcattctctcatccaaaatctcaaccttttgaggtcattctctcctccttttccatcttaaaaccttaacttccatttttcctagacatcctttctacccaactcctcttttttctcaaaattcaaatcccccatcttttttttttcatcttatcctgtcccacttttccatctccaagctcaatttcttatttataggtttttatttttaattaaaataatataatctgatgtagtaaaataaaaaaatttaaccgattttcagtttaaaacaattttacaaccatagtgtataactctttaactatgtaaagaatatataattaaattgtcatatattatatataaatgttatatacagtaagagaaagacatattttgtaattttttatatattatttaaaaataaaatataaaataaaagaggaaagaagaaggggaaattgaatagaaaataaaagtattaattaattttataaagttatagggcaatttaataaaaataagtgaaannnnnnatatatatatatatatatatatatatatatatatatatatgagtgtgtgtgtgtgtgaaacatattttataagagaaaatatttcacgtgatagtgaaatgattaaatctgaaccatataattatatataaaggattaagatttagtgtcaaaaaattacatgaatttttaagtgactacatgatattaaatcttgatcgtccatgttaatttgattattcagttcaaatttaatcatctcatcctcatataagatatcttcctctaatatgatacgtcctgtctctctcaattatcttgaatttcaaaaaatgaaatgcttgattatcttaataaaaataggggatcaaaattgaagataaaaaattaaagaaatcaaagttataatttattctattatttaatatttaatgttcattaagaacaagaaatttaggattggataatattttaatttttttgggtaaatcttttcgaatcattaaattgtcttataagtaggactgctcaaaattaaactttattaaacacaatttaaataaagatttgataataaccttttaacacttagaaaaacttttttttatatatcaaacaatttttgtatgaaaacctcaattaaatttgtaaaagagataatgaaaaagataacaacacaatttttttacattgatttgttttaattcaagaatacatttaatttttgatatatttccactaactcaaacattttgcaagtattattttgccaatgcctcttcagactcaacatgagtattcctttactttcttctccaagtaactcaccatgttaactttcttagagaacctcctgaggcttcaaccattttcacttagaaaaggttagggataaaaactcattgactatattgtcttaattatatacacaaatgtacaatctacgctctagtctgtctaagacgattagctagaacatatctccttttgagttttgagccgacaattatactatcatactcttaggataggtaaacacatgtctattgatctagataatgagttatcttcgtttgattttcacaattcttccttgatacacttatgataacctttcagattaattgtaagtgtgttttgttcgtgcaacatgaaataatatatatatagacacacacacggggcgcatgcatgcatattcacatatattggtagtaggttgctaatagcgagaatttaatcattttatcatatgcgtgaagataaggtgaattcatactgaattcttatgtaaaaatgttttaaactataacctacatttgcatgaaaggctaaaataaaaaactttgagaaattattgtcttacttgatatcaatatataagtcatctgtataaaggttcttttaaagtctaattgctatatactcaagaatagaaaacatgtttcttcacatcacaatgtgtccacatatactcacatctaagatgtgagacagaatcataaatgcaggtgtaaagaaaacgaaattctaaattatgtatagacatgcatgagaacaaagaagttatgtgagtttttactaaaaaaacattattacttacttgaagggattaatatgtgatagtcgacttaaaaaatatctttagtatacacaaaataaagaagcttgattacttataaaagcatgactaattaacttgaaatccaatattaattatatcagatcctctatcaaattaaaatatttttatgctaataaaaatacactatcataagaatacatgttgcaacttgcaacaaatcgttaatgaacctagctagctagctaatatccatagtcaagcttgtgatgcattaatgtctcatttctacccgtggattttgactttactgcttcttttaaaagagtagcatttgaaagaggggagaaattgtgatggtcacgttgtcaaatttcacagcagaccgcaacacaaccaacctggggcaaactcgttgattttcatcactattcactcttctttctcagtctagtttgaaccagtcaaacttttccaagaaataggcatccaagaaaaccctccttttggattcaacaaaacaaagatcaagtcaattacctctgaattcaagaaacaagcatacacgtgcacacagtcagagagacatatagggacaaaattgttaaatccctgtgtgaaaaggatggaacacaatgtcaaaatttaacaaaaccccgtttgacaagctttaatcgcgtacagaattccaggcatttctgtcgttcaatgtctcttgttcccaatctcaaaaaactcaaaaactcaaaaagtttaacaaaagccagtctagcaaatgacatgtacatgacataacatttcaatctcgtgttcgtgtaggttattatatatgcaaactgtgatggttgtattcaattcaccccataaaatgccatccgagtctctattcatgaaaatgatgaattcatttctatacatatttttaatttaatttgatcaaaatacatcgacatttacatagtataatatactagtattgcatgacaaaattattgattcatgtaataattattttaaaagttagacttacatagtttttaatcagtttaaaatctaaaaatctttgcaccaataatatatcaattttttccatgtaaatacacatatttttattttaatacacttatttaaaaatgttatatcaaagttaatttatatttttgtacttaattaaaggaacctttttcttaatttctttaatcaatattcaaattttcaattagacaataatgatgagccaatgacttatttattttccttcaaaattttcaccattagacataaaaatatatttttttaaattacaattaaaataatcttatatcaaatcaaaataatttaaactgaaatgtcaaataaatgtattttaatatctcaatttatattttacataataaaaaagttctatcaatcaattcaatattaccttacatatttttaaattgatttatttttacatttattatattcatatctatccatgcaatggaccagatatttgcaagttgtgctatatataaatgaatattcgttcaaacaaaccagctacaacggtgatttttttttttatatagttaatcccattctgacaatgagttgataaatgctctaagttgattaaaattgaattttttaaaagagaaattaaaattaaagaaaagaaaagaaaagaaaagaattgtgcaataataactagagacaattatctgaattaagaatatcaacagggaaaatgaaagtcaacaacttcctcgggcgtaatgtctgccgtataattctgaaaaggattaattagctcttccataccttctaccaagaacaataatttatacttctatgcatccaaaatctaaaagtatagtgcagcatttattactaattttttaaataaaaaatgatttcaacgaaattgatatgaaaattgagaggagtgttatatataaccttgcaccatgatgattatatgtgtaaacagagaaggttaagacaataataaagtagcttgttattttcttacccattttaattatttaaaatgtattaatggaaatgatttttatactgtgatttaattacaaattattatgaataataaaattattatttttataattgttttagaagtcatatataatttctaattaattgactatgtaaaattgtttaaaatgatactatatgaaaattaaattcttcagaaaaatatgaaaattaaattcttccattatttaaaaaatatttttattttagtatttagctattttcttgaaaaaggggaggggaatgaacaaattttatagtactatcttgtttaattcaaacttttagggatacatctttagtgatagatctcaaaatgagatcttaaaccactttttggtggacaaagtatcatgtaggattgaaaatttctcaagatctttctatcttttttaatggtagatctcattttgagatcttaaggagaaagaaagaaggaaaaaaattattcttttttgaacaatatgaaaatcttaaggaatcttctacaataacttattctccatgttggaaatctcttcatctcccttattgagagattgaaaatcagatcttaagtcaagatgtagcactaaaaaaacccatttcctcattacatatggcactgatgtcacgatccctgttgggaaccttcaacaaaaaagatgctctttcaggaatagtgtaataaggaaaatatgagagtcgagttggacaccaatgaagagatttgagacatagccagaattaatgaagaagtggccaagctctgcaggacaagaagatacaattctaaagttcactttcgaactttccagccaggcaatctagtatggcgtgtccggggtgaagtcaagaaagatcaccgtgcaggtaagcttggaccaaactgggaagacccgttcagagttatcatcaacctgaacaatgacgcctacaaactacaggaactcaatggtaaagacattccaagaacttggaatgctacccacttgaaattctacttcagctaaggagttgaaggccggatgacgtactatttttcctattcaagtcttttgtccaattgggttttggtttgaaagattttaaccatgctcatccgaggaataacatatataactatatctgatttaatttttttcctttcaattttttgctttttaaaaaattaatttttttaaaacaaatttcaaaatttgatagatcatatttaaaaaaattaactgatgaatagtataaaattattttccaaaacagtttttaaaatgaaaaagtgaaaagtgaataaaacggaacctaaaacctcccttctgccttctcacaattttgtcttctaatgttaggaaatttgaaagaaagtaaaacggagttttaaaaaattgaattattttttttggttgcaattttttaaaaagtatattaacaatctgaccattttcatgtattaccatttactcatttagattcttatttattatcataagagtataataatacgttaatttcattgtttttttctcatcctctttaattttttcttcgtcctcttgaccaaatagaaaagaaggatttatatttttattttcctatcctttttgatcgtctctcctctgttaaaatctttggtatccctttacttccaaaccacataacatatatatagtctttccgaggctgttaagatggtagtaagacgcatctatatataaatataaatataaagaaatatgaagatccaatatttaaaagaaaatatggttggtaacgggaacgtagtggttccgacgtcaaatatcaaagatgtagccccaccaaattttataatgaggcagcatgaactttaatccttttagatttatatgtaataatcattgagtattctagtttcttattcccgtgtcaaatcctcaggtttaatcactgtaccgcatataattaagtatctatatatatatatgtgtgtgtgcgtgtgtgtgaaattaatcttttgagtcgtacgaaatggttaaatcaaactctattcatgtgaacaatttaataacttaattactcaagtccataatatttcaattataagtaaaattaattggaacattgatacttttattgcaactaaatatgattggattgctgatgtttgctcagggaattatatatcaatacctttttttacaagttacagttaccacattttgtcattttcacatcaattgagatttagtttgactacttttctatttttttttctttctaatattctataaaattattagtaaatattgaataaaaattaaatatattaactatcttaaaaacataaacaagtttaacttttatatattatttagtaaagaagagataatttgtaggaggatgttataaaaaataatcaacgcatttgcacatctataattactacaccaactagtggtctatcccataggttaaatcgtcttttccttgatacacaacatgcaaagtatagttaggtgggtttttgaattatcgaaatatgagaaatgagtgtcaaatgatttcccgtgttaccgacaaactaatgctagcaaaattaggcagcgaatcatgaaaacgaagtttaggcttttagcagaaactgttacgtttcaccactttctaattatatagattttcccccaaatacaggcttgcaaatgagtcagaacattatccttatattaaagcatgcatttgtgatctccgaacaaaagaaattgattaacatagagagagaaacaaactcatccatcttaattcccaccattcaaatctgaaacgacagaaataatttggttcctttatgcctaatcaatactagtaatttggacacaagaaataagagagagaaagagagagcaacatgcaaatgaagagggacttggaaaaccagccacaaattttatttcactgtttttaatttgacgaccattgatgtcctaaaaccgtttacaaatgtcttctagctgtaactatctctattctcttaagacttactgaaccgacaaaaatataacaagagtgaaaatataagtgatatcatcaattgcaacttgcaacacacataaatatgattacttatagaaattaaaattaaaaaacaagttgatgaataaatgcctggctttcccatgtacgcctaatcttcctccactggtgaattctccaccagtaacaacgagatcctcgtcctcaaaatcatatcttatacccatggtgaggttgaaaatgaatctccactgaccccacatgagttgcaatggcatttttctcaccactagtgccatccatgaacctcttcttctttttcttgttcttgttcatgactatgcagcagattgatgccttaaagaactaaaaccataatatatatttgtatctagctaggatatggaaatggaaagagtaattaagaatactaattaaaagggtatcactttgtttaataacagagagtgagagagaagagatagagagaaaggggagaggtagaaggagaaggttgttcccaagaagatgacgagcatttcccgttgatgttgttttcaaagagtgttttaatttccttagggtgggccaggaaagaaggcatttttgtttcacacgttggggtggttctctttgtcttccccgcaaacaacagtcaatggttttaggcttaaccctcaatgaatgaatgaccgaatccactttatttatttattctcaccttgtcttcctccgtttctttaattaggtttcctttcttttccttctgcctctcctctccctatgcgttactagctgtatagcttcagctgctagggaacaatgtacatccaaaaaggtgtattaatatagactaaccagagagtacatttctagtaataactcatgagatatttatatcatctgatcataagaaaaatataattttaaagaattttttttgaataataattatatttttaaacaaatatttgaataataattacaatttcaaaaatcttatataatttcccttaaaaaatcgtatattatttttttaaaaaaacacataaatataaaataattttatataagaaaataatgttatctgatttgatatctaacctataccaaaagcttaatatatttttatcgtatcatactcttgacctgcatttaattttatcttattacatcatatatcataatcaccaaatgagcttttatactaatagcacttaaactttaaagtaattaatatacacacacatttactaacatatatagcatcttattttttaaaataaacatttaaacaaattataccttaaatgtttttgaaaataattaaaaaaaagagtagattctactaactactctagagactttgcgaaattacacattttttttaacatttaccgtattatgtcttataggagaatagatgtgatgtttttcaaataattaaagaagttaatgtaatatataacatgacataagtgtatatttgtcaataattaaagaggttagtgtaggacaatcggagtacataaaaacacggagagtttatttaattacacaaaattttaagaatagttagtataatttattctaattaaaattataacttagtaaataatttattttcttaaaaaaagagagagactgtgttaacaaattaatattgctatatacatttgatagtatgtatgacacttgtctctatatccgttatattaatttgcacttacttgtctctccatttatggctatacttatatagcaattcagtgtaaaatatggaatttggagtggtagatgtttaatcaactcgagtataatcttgttgaatgtaagtactcgataggggactagcagattcgatcttatcgcgtgttgtttgaagcttgcaaatgtcaataattgagcaaaataatgtgtgactgatagttcactgcatttgataccattacattcgagtgatgccatatatcaattttgatgtgattgtgctatcatcttatatgcatgaaaaaagttctatataaacatggtgtgaatcgatctgtgagatttcttttaacttctttttaaaccaaaattgctgtatggtgatagatacaatatgtaaagttcaacacataaataatgtgttttgattgataaatattctccaacaatagtttatttgccaatacttgtgatgactttaaaagtgagactgtatagtaaatagtaaggagtctcgtacgtgctaagcacgagttgtgtcaatttcaatgtttaaatatacattaagtaatatataaatacacatgctatttttaagtaattatgtgatggaagatataaggtttatcaaactgattgtgaaagagtaaaagaagctggttcgaatttctgcaattgatatttgtgacaaaactaacaaattaacatttatttataaaaataataattatgtgactattaactaacttttagttttcaccatctatatatttttgttcgatccaaacttattataattatcatttctcgtataacaagaaaagttcgcacttgataagctctcttctctccccatctatttatccatcgaggaaaaatcaaattacattagtataattttaataattattatatcatttttataatttgatataaaatgttatttttattgatctaacctttgaactatatttacatattataaagatcaaatatgttaaattttatcaaaattgaacaaaaataaaaaaataatcaaatgatctttattttaatatattttaaaatatttatattacatcaattttaatatatataaacgaggtaacaaataatctctcctcacatatatatagatatataaactcttagtgataacatttgtttattatgagaaatgagatcactaattaataataatctttggattaatattaaaaataatagatcgctcatgttaaaattcaattgtagtaatatcttgtgagatcactaattaatgttaccaccactactcatattgtcactgttgtcaacttgtattcgctgccaaaatgaaaactataggatttattatttttaatattcatctaagggttattatatataaaatatattaaataagaattattgttattgtagaaaatgaaaactataaatttagacaataagattttggacatattttgaaatatacaaagttcatgattatactctttggtttgtaggcagggatggatcctaaaaggtcttgaaggggggacattttttaatatatgtatatatattgtgctttgattataaaaataattcgtcagtaagtgttaacaatctgaatctatatttaacataatctattaatggtattggttcctattttgcaaaattttaattgtagcatagccatttaatttataccatcagatcctagctactctgtaaaatcttaaccatatcgtcatttgcaccatatgaaaaagatcatacgagaggggggaggggaaggattcctgcctactccccttggatccgtctctggttagaggattctaatgatagctctgtagttaacgggggagtcttcttataaaagaattattaaacacttatgtaagtagtaattttgttatagttatacttgtgaagaaaaagttgtatgatgatttaagttgatggctttgagatggaagcaatgatgattttgatgatcaacctcacagtcgatatgatggctagttatattattcaatttaataataagtatgcatgctaactaacttcaattagtaaaaaaataaaaataaaaacattattaaaaaatatttatataaattaatagttaaataactttaaaacaatacatgacaacctgtgcgcacagataccttgctacttaacctttataaattgacacaagactagttcttcctttgtaaattgtgtcaatttataaaggcaaaaatctcagggagttcttcctttgcattcctaaccccttatcctaattaacaatgcatacctatgtgatgcacccaatatacgtgggacttccacttttccaaacaaatcaccataaacatgttaatcgccaattttaaacattagcaaaaaagttattatagaaccaaatatttaatatttttttttagaaaagcattatgattatattattatattatagcataatatattaacaacaaactcaaaataaaaatgctaagaaaaaataatcgttaaataatcattataggattctagttgttgaaccaaaagataaatcaatggcttgaatgttcttaaaagaaactgaaaaagtattatagaaaatgttgacacttggcatcgagggaagacttttataataataatataataataaatatattttacaaaataaaacgatatttttataattaaaataattttttttttcaaaccaaacaactttacaaactaaaccgtaaagccaatcatttttcggactttacatgacaaaccaccgtcatccaaagtgtttttttttttgtcgatggtcgaaaccattatccaaagtccaaacaatctataatgttgcaaattgggtccattgcggaccagtcgacgtccacggctcaaatttggtccattgcttatactaaaatccctattttcacggaaaacgtttccagaataggttcagcaatgtctcatggaccatattttggctgaacagtgatatatagatatagatagatagatatagattacacaatcctcacccatcaccccaatttatttgcagatactagctagcacatatataaggttgcaaatcactcccacttggagtaaatcaattaagattaaaaattttgaatatattttaccaaatttttttaggaaaatatttttattaatatatttatgcaattttttttattaacataggaacaatgataatttttaatataatttattcacgctctcaaaatttttacaaaacgtttaaggaaaaataaaataaaataaagcgtgagacatgaaagagagaaagtcacaataagaaaagtgagtctgttcttcctgtttctcctacttattcatcactttctagatttccgtcttaatttctaggcgatcgataatcatactcttgttcaagagtatgtcatgtgatctctccttcgtgaccattagtcaacaaagaaaagatgtgttcgtggaaaaaggaaggaagacttcaattaattacaaatttcaagctagaattaatacatatgttgtagctagggtaataactaataactagataaagatctaaacatgaagttacagtacgtagtaacaaataagtcataaacaaaagcatagctcattcaatatacacaactagtacatgaagttgattcatttcatttctttccaaagctgaaaatttgctcttcagtaacccaacatatatgctgagccgagggaaaatcaattcagaatacaagtgcaaagctaagcaatatgacaatcattccctatatttgtgtaaaagtatagtaacctactagttataactcactagaccccactccaaaagaaaattaatcttttaaccatatcttaactactctctaatttgtgaaaaattattacatggtccagatcattgcatattgatgatgacctagatcaatcttcgcgtgacatatgcatgtgtcacaaggagattgcttcttacacaaaatggtcttggatcatgtaataattttttgtatatgatctttcaccaattaagagaggttcacactcaatagcttgcaactccttcatgagcatcatcacctcatctagtagcgaaaggaaaccaacgttggtggaaggaagattggtatgccatcatgaacaacacgaagagaagtaagagtgccactccccacggagaccctccagctctgtgcagcgactccctctcctccggcaagggtattgggaacgacgcgccgctcgagaggcagtgaaggaggagcaacaagagcagcggcacgagggcgaggaagatcttaacctgcacgagcaagtcctcgagcaaggactcgtagtttatgtaccacgagaacgctagcacgaagaaaaggatgaacacgaagaagacgaggtggagtgggaaagacaagtaatcccacaagtagtagtagtagggatcgtggtacctggccatgttaagggaaaataaaatatagtgatgatgttagtgagaaatggttgagaatgaatgaataaatgagattttgtttgatagaaggaaggtgtttcagatattgtgtggagtcttctaggggctttgatttgaatagacagttgggtcaaaaaggtttatataagcagtaggactaagtgggcgcaggaaattaaatcactatggactacatccatgattatttctttggcactaaaattagaagagattggtctcttttatcttgcaatttttattgcaaaaaattgtatgatatctatttctttgaatgtatatagtcctttagaaagagaataataagaagagaaaatgggtggtacgaagaactaacataagaaacagacaaaagagatgtgataaatcttataataagaattattttctctctctagatagtctttaaagtgttgagagtatacaaatttttaaagtattgaatattcattgatttaagtgttagatgcattaatgtatattgcttacatttagcgactaatttgaaggatttttttttagaacttgagagattatttagtaagatttttgcttcttgcggaaggattaattatataatttgcttaatttaaggattatttagacgagaataatatatactttaaggatgaaatagataatttattacaaaaattcatgttaaaattcaagttatcttataagaaaatttattttgtttataaataatggagaaaatgtaaaaatttataaaatataaaatggtaacaagaaaatgggaatgaaaataaaaattgaatcctatttttttatgtcacatgatgtgattaatttttaattttgtcttatagatataaagtcacaatctcactagttaagtttttaggtctagttattacttgaaaacaggagtctagtcctttcgttggcgtccgacatcgaatagaaccaaaaaagtaaaaagaaaaaggagaaggaaaagaaagtttaaatatgtttttagattgtgtacctataaatatttttttatattttattcattttgattcatataaatcttataattcttaaaatagtttttatcatttaatgaaaacataatatacatttaaatatattatattcgtaattattttgaggtgacgtgtgtgtaggtgacatcataaatagtaagtactaatttttttttttataaactataaaatttataagaactaaaattaaaaaataaagtcaaatttcactgtatttaacaaaagaaaaacatacgtatactagtatattataacaaagtgaaattcctgtccattttggcatggcttctactgcttcaagagaaagtagagattctactttttttattctgatgagtagtgacgcatcgagattatcccagtgacggtgagagtgagaataattcatggttgagattcaaaatggtgtcatccaataggtgagtgccagatactttggacactggaccagaacgtgtgaacatgagaaaaatcaaggaagttaaattatttttagaagccatgcactgtagtttgtgataaattggagacaaagtggggtcatagcattgggaaaactgcatcttgcttattggagggtggcccataattctgttttcaagctttattcgtagggtttggcgagccatgtccgttcagagtatcttatcagataaaattaggtggatttgcatattcctatgaaaaaataaatgatattggtaaacctcgctaagtatagtatatactacactcaatgatatatagaagagaaaataaaataaataaaagataaatattatataagaatatataaatatcattattgatcgattcctgttatccatcatatccatgcatgctccatcatgcattgttcctccgttcctttactgcagcttactttctttagttcttgaaatattctcttaccaataatattaataatgcagagcattgaatctacgattttgttttggtacgttggaccactgtagtttaaatccaagcatcataataaaaggatatatatatatatatatatatatatatatatatatgatgaataaatccagttgcacgtatggagcaaacctggtcggagctaggctctcgtttcattcatttaattggtactcaacatgaacaatagggtaataacaagtttaaaatatttcatgaaaaacaagtttgaaatatttgaaataattatttataatataaataaggtttaattatgtttttaattctttaaatgagaaagtctatctttttagtactttaaataaaaatttatatttttcaatcactctaatttgaaacatgttcattttagtccatctaatttgaaaaacaccctttttagttcatctttaaaattggaaagactaaaaaatgcatttttttttaagaaatagactaaaaaaaatatttttgaatttgagaaactaaaaaaatacatttttatttgagagactaaaaaaataaatctccttatttgaggtactaaaaacataattaagtttagaaaataaagttatgaaataatgagttttaataatttaatcagtcacaagggcaatgcacaacacatacataaactttaggttgaaaaatataattttataacagtgtgtttaatagcacaataaaataatttattatatcaaaataaatcaatgatataggaattggtcgcaatcctcttacaaaatgacaagatatccttccctcaaaacaccccttgttatttatagaaaaaaagccttaaccaaattaaactatctcacatgactaactaactcactaatataactaacagataggtaactactaatggggagtacgtaacacttatgttctcgacttttttcaccaaacacaaaacaatttattcaaaaggtgtagtatgagaataatttttatggcttctgacgcttgtttgatatgtagcggaaggagttatcccgagtgacgcatcaaagtgatagttatttttaactttctacatcatttatgtgttatagaaaatagttttttacatcgattatagtcatatcaatgtaaaaagtatttattgtattcaaaattgatcctattagaatctctcaaatctttctcattcttgctaagatctttatttgataccctttttgtgttctttacttctgttgttctgtgtgattcaactcttatttaagcaaatatgtttgcagatcatgatttttccaacaaaatttaatttgatgattgattaagcttcttgatatatgaactaattaacattgtatgcatatattttgtgctatatgttttggaaaaatggcatgttatttacttcacaattaattcttatttgagaataagatgtgactgtaggccaatagagaattggataatactataaaagtcagtctttactggcctattggtgttgatttctttgactcaaatatatcagagttacttttgttgtcattatttataattgtctttactttgtttggtcatgtagagtgcccttccccagaactgagagaagtggtcaagtaaacctaacattgcgggagtggtatcgacttaaacaattcagggaggtatgttggataaattgattttttgtagttgtaaattttgatgtcaatctgtcttaatattgtgaattttatttcccagtgttgttgaagaaaagaaaaatctaattcttacggttccagatggatgtgggcgagagtatatattcacccttaaggtgattcatttattatatttttaagcgaatgagaattaaattcaagtagtactactatttctaaaatgccttattaattgtgggccatataaattctgattgttttctcaaatatcaggctgagacgtcagaagacctgtttgaatgaaagacaactcttgaacaagccctcgcacaagcaccaagtgctacccttttttatgggacgcaatgggattttccggaatgacgcaagtgatcattctaattctattaagatatcgaagggtctttccatcaatgtatgtgtccacattttcgctaaattttgtgttgtgcttccaaggagggacaagcgtccaattaattctgtaagtctgtgattgttcaaataccaattctgctagcacttgaagatattgatggaggcatgtctttcggtctttccttaaaaaagctgtttgatttatacttgctagagaagtatggtaagttatgatcttctattgcatatatgtaatgcatctgcatttcctttcacttcttaagtgtccgtgatgaaattttagaagttatatatctaagattcaaattcgatatcactaaatcttgagtaagttgattcatgtacttagtggtaattaaattattgacaagtttaatattaataattacattgacttagtttcttaattattaattaaaagagtatagaagagcagagggtagaattatatatactgtatagtaaaaagatgtgtcacctacatgcctggttggcggaaagccagccctagcacggatagagtccatgcttttatttcttatttcttacatatgtactagttattacatggagtacacacaagtatatgtgtgtttagttcatatatttgtgaattttacttcagcaacatttgcagccctttcgaccgcagcatttgcatcctccgccatgtcctccgccatgtccccagcctccaccgtgtccccatcttccaccatgtccccagcttccaccatgtcccccatttccacctcttccccaggcatctggctgtgtctttggttcttctgctgcacaggaatagacaaacatttttaaatattgcactgattggttaatttatttctttttcttttttcaaaagttacatttacatgcataactactaagcataataaaattaatcaacagtaacaccattattaaaattcattgtagcacccgaaaaaaatatattatggtagaaatggggtcttgtggtggtatgcattacttatataacagagccaatatatgccaaagcgaaagcaataatgcaaaacaaaatttatttttgattatgtagaaaataaatgtataatgtcttatataccatataatttcaattggcaataaaaggaggagaaacacgccttaaggtgacgacttttgaaactaaaactgaatagcaaaagttcgatgtttggattttgtttctcggtttcaacactgcaaccttggacaatatatatagttgcatgcatgggaaattattctaaagatttcaggagaatttttaaagtttggataatttgtaatgtattaaagtggcactgctattgctgcgaatgtagaaaagtatggcacttaagttgcagacttgtatagcttcaatgttttagaaatctcaaataacttcacacaaataagtcaatacatgaccaaaatatattaaagaagaaagcaatattgtgcaggtatggaaagtggaaactacatagccaccacactacctcagcgactagattaggaaataatttcaatttcaaaattaatgtttgattgttttactgagaggggaataggattagcaagcaattaaagaaacatgaagactaagtggaaggataatggttaatattggtgatttgagaaaggaacaattgcagctagctatataatatacattaccttgtgtcccatctttggatggctcagttgccacaacagagatgagaagcagtgcgcagaggaagcacaagaagaaaacgggtttgttattcatttttgcaattaggttatataagatgagttgctgtgaagtatatagaccgtgtttctcgacagctatttatagtgatcatgagagaagataaacgaaaggagataaaaaaagaaacgaagtagatgacagtggtcattaaattcgttttcttaaattatggtatttatcttagttagataactggaattgtttggctgattgcgaggataatagggggtcaatgatccttatcaacaccgattgagccattaaagtgttagactgggacaagtgtgtatactgaggtaaccaagtttatcagaagatggcaactggcaagtgaccaagacaatgtgcaaactggttgcatcatatttaattatatacaggaaataacaaggatattacatcatataattaattagctttaaaatattcaacaaaattgctacatataatcattaatcgacatggatatattagtgtttcggttgaatatttcaaaatttaagtcccacattaatagtttcgggatttcttgttgggtttctcggatcctcaaatatcaaattgcggaagcagaataaaatcaaagggggaacgagagagacaatcagaatttattttacgtgagaaaaccttcctcaatgtgagaaaagaaaaactcacaggacctagtccaatatcaaatccactataacaaatatgagttacaatgaatcaaaaacacaccaaaatggtggtacactcaacctctccaacaatggtggtcactcaaatgctcacagtgtttcattctaagttctcaaatatgcaagcatggtggcttgctcaaatatggcactcaagactgtcacttgaggctctcaaatttccgtgtcttttgcctccacccttactcatctatttataggatgaaataagtttataatgggctgggcctaagccatcaaatatatcttatcaaataaaaacaagattatatcttatcaaataaaagcaagattatcaatcaactaaaaacggaaattatccaacaaatctcccccttccgtttttcagtgagaccggggtcttcaacttcaacaacccgaccttctttctcggcttcaatgtgccgaattcatcaatccggctccttcacagcaatcttcaaatttccatgctggtaccgacttggtcatcatatcggaccagttcaaatcggtgtgcactttgccaagtgcgagctgtccagcctccaccacatcccagatccagtgatatctcacatcaatatgtttggtgcaggagtgataggtcgagttcttcgcaagatgaattgtgctctggttgtcacacatcagctcatacttatcttgttcatggccgagttccatgaggaacttcttcatccacaacatctccttgcttgcctcgggtcacgacaatgtactcggcttcggtcattgaaaagactttaacctatctaaggattcgcccactcatccattctataggcccatttgatgttagcgaccatgacaacctccaacgctagattagggaccttcttagcacccgcaacttacatacctactcacatgtaatgtcattcatcaatgcatatcatgttatgatcattcaaatcaatatcatatgtcatcacaaatttattcatcaatctcaacaccataagagattataatattatagattcacaattcatacgttaatcacattcatgaacccacatatagttcaataagcataacaatacattaatttcgacaccttgatttcttgcaagcaactcacataaactcatgaatgtgaatatgatgatctcaacacaaagtcaactctaataataaaacaacattatctcaaccacatctcatttcatcgtacattcattaagatctcaaataattattttacataaggaaaacaagcattaatcacatccacatccaaattggtcattggactccaaactaatcactactactcaaaagggtcactagacttaaaatgatcattggactcaaaactgactattggactcaaagtggtgtgatgtaggctaagcacggcaagcgtaccgctttgtcaagtagtaacttggtaagtctgaggtcgatttcctcagggaacttgcttgtactgagagttgatatatgtctaagtttaagcgaacacaaatttaatttgaaagttttctactctaattgtggaaatgtaaagtgcaaggtaggtaaagatagttgagcatgggcataataaagagatagaaacacacacttgggggtgcaatgtcggtagatgtggaagatggtgacgtgtgtgagttcaataaaccaaaactaccattgattcaatattaaaggtatttctctattcaacgattaagttcgctcacccttatctactaatgtattctaaccttgattcctcaagcactaaaagcctaaatcatttgatttcactcctgatccctcagcaagctagatctagtaatttgcattaagagtaaagatgattcgtaacctaggctaaacaacatcactccatccctagacatgacatcatttagaagcgtttttaagttctaaggaaacaaccatttctcaatgcattgaagccctataacaaagcatgcatatgggagatcaaatcacacacatgaataagctcagaaaaacacaatgatacgaaaatagcattaaatagatagttaaaattattacatcaagagtatcgttgaaacccccaacattggatgggttagcttcccattttcatgagagagcttacaaatatggaattaaagaaggagagtggaaggggaaggaaggaaatggaggaagagagccccaaaatgagtgggatcctcccttctctcgtgccctagctctgcctcagcctccccaagtctccatgagagtggatcagcaaaaagctcctcattttgtgcccgaatttctcttttatagtggcccagaattgcggtgctcgctgagcgggaaaaggtcgcgctgagcgcgccctcccttgttcagctggataagtgaccacgcgctaagcgggcatctgacgcgctggacgagcaactttagacctttaattctcctcttctttccttgcagtgaaatctctacaaaaacacaaccaacccctcatgaatcaactaaacttagcatctgctggacaaaagctcgaagaaagctaattcttatattttatttacaaaaagaagcattaaaataggaaaagaatagataaatgctaagtgattaatatatggttttacgtatgcttaacaattatcatggtggctggactcaaaatgatcactggactcaaaatagtcattggatgcaaaaatggtcaatggacgcgaaactggtcactggacagaggtatgacagagattttggcagggtcgagggagagtaggtgcaatggttcttgtattgcacataggtatggacgaagatttttccagcgttaagtgagagagtagtggcgatgagggtttgctcggtgatgtcaagtctatagatcattttaattgtttttcttaattttcgttttatttttggttttattgtcgaatcattgtacctcttgttcttgcaaggggagttcttgtagcaagtgaatacagagatgttggtactcgcccttgaagtgaaagtatttcatggtttgatttggatttaattgtacaatggttggaggacaaagagaaagggacaaacaatgatgttgtgccataaatgaatgatttagtacacaggtggatttgccttttttgttttgttgcatttgggttatttaggtgatgtttaatttttgttttctttttttgaaaataattttcattttcaagatttaaaaaaacatgtatcgagaagaaagtactttaaggtgtcacaacattttcacttctttagaaaaaattggaaatgttaatttgttgttaagttttgagcctatttttaaaaacattttcaaagaaaatgtttttaaaattttaaataaatatattttcacttttatttttttgttttccttgaaaatgaaaaaaaaaaacacactcaaactaagagtcactttaaatttagtgtttctatttgggttagtgactgttctatgtaacatatgcttgattagtattcttattagcattttccttcaattaatttggcatgaataaatgggaaacgtttggggaagggatgttattgtagaaagaaaagaagaataaaacagtagatgtgtagatattgtccaaggaagggaagaagaattaggaggaatgagatcttaattagcaattttttttttattttttttttacaaccggttgatgaatgactgttataagtaaaaatgccatgttcacaggtgaacccctattttgaaacttcaccatagacaaacccctttatataggctctctactaatcacaaactaaatctctaatagcttgcagcctataaaattaactttcaacatgattgatatatatatatatatatatatatatatatatatatatatattaaaaatatatggaaaaggatatttggtgaagataatttcgtgaaatcttgaatgaataaatatatagtagcgtcaatgaatataattttgttgcaaattagatactctacgtaaattgtcaaattttcattcatggatcaacgtaaagtattatatgaaaatggaacaatgaaaccgatcgagtatcatctccaaagctacatttaagttcaacaaagaactagatactagttgtctaactctagactttggttccatgtcaaccaacacgtcctttccctttattctatatgccatagccttccttaatactaattcaatatcctctttcgccacctttgtgtcctctttctttgccacctttttctctttttccatgatcatcgtctcctttttcatcacctccaattcctcctcctttatcgccgccaccagcaccatagcctccgccgtcgccaccactagaacctcctccttcactaccaccaccaccaccactgtaacctccgccacctgatccacttccaccacctccttggccgccacctccacttcctcctccttggctaccaccaccacaacctccaccacttcctccttggctacctccacctccggcactgccccctcctcctttgcttccaccaccttcaccaccaccgccgtaacctccaccacctccagcgctacctcctcctccttcgctaccaccacctccagcactgccccctcctccttcgctaccaccacctccagcactgccccctcctccttcgctaccaccacctccagcgctgctccctcctccttggcttccaccaccgccgtaacctccaccacctccagcactacctcctcctccttcactaccaccacctccagcactgccccctcctccttcgctaccaccacctccagcgctaccccctcctccttggcttccacccccttcacnnnnnnnnnnntaaatttcgaaaaaaattgaaagaaaaataaggaaagtcctctttttaattcatttaaatataattttataaattatattggccttaattaaataataaacaaaatcatacatattttaattttaaaattttcggttacaatagttattaatttaatattaaatgattgaacataaagaaaagcaaagagaaaatattcatatgataagtaatttgatttttcatttgatttaaataatgtgagatggggagtaaagcatcgtgtaaaatcttttttttttttttttaaaaaggaaacaaggcgttacgaagaagggannnnnnnnnntcctccttcgctaccaccacctccagcgctaccccctcctccttggcttccacccccttcaccaccaccgccgtaacctccaccacccccagcactacctcctcctccttcgctaccaccacctccggcgctacctcctcctccttggcttccaccacctccagcactaccccctcctccttcgctaccaccacctccggcgcttccccctcctccttgacttccaccaccaccataacctccactgtcgcccccttggcttccaccacctcctccagcttcgccacctcctccgcttccaccacctccggcactaccacctcctccttcgctacctccgccaccttcgccacctcctccgcttccaccaccaccataacctccaccactactaccaccacctcctgatccaccttcatcgcctcctccccctttgtcaccacctccctttccctttccttttccctttccttttccacagtgatcggtatcatgatttagctggaatttcctaccactcaaaactgcataaaccgccacatttaagattcacgtaccttgttataaaagaaaacatgagaagagaaaagaaaatacttacggcttccctgcacttcatcgcatccactaaattcttcgtgaattccgtttgttcctgcagtttcatcaacaaaggtaatgattagctataaattaagatttaacttactacatgtcagttttacgtgtgtttcatgaacttaatgttttggaaaatggagtttacttatatcacttttataaacaatctttttgactaaattctttaacaaattcaaataattgatgaacaaataaagtgcattattatcattaaccttaaacaagttaaggttcatacctttttcctcatctttcgatggctcaccagccaccaccgcagcgatgaggatcaccccatacagaaaacaaagcaaaataaagggcttcaacagattcattttgttagtgaacataacaacacttgagaaggatgaatgcaaagactcaacaagacccatatatatagtgcaagaaaagtattaaagtattgcatgcaacagtgtgaagcgggtcctacttctgaaccatctccttaatactttttggtttcttggcgtattttcaggccttttctctaactttaccttgaaaatacgattatccagacgttacattgcacccagattcaaacctaattaaggaaaatggcaaggcacattgaagttcaagtataagatatttattgagatgctctcgatagaatcagttccatgccctattatccgcgcatcaaggttgaaactttcttctttaccattaatgaagataatgaagaacaagcggttcaataggcgtgttcatgttcttgtgacaccttgaatacgcgtgttcatgtaagaagtaagataccatgcccaacctcggcatgtcatctacataagcgtttcttactttctttcaatcaaactcattgaagaagaaagagagagaaaactaaaaaggacacagaaaaggagggatcaaagagaagaaggaccatttatgggtatcatgtattcggtgtaactgaatttccatggacggtgcatgaggacaaagtggatgaggctagtaatgttcttaatttcatgaaattgaacacacgttatcaacacgtacgtgtatacgtgttaacaattttttttattacactctgtagattgtttgaaatttgaatgagttaaaatgagcttcactaactactgtatttgaaaaaaaaaatcatttaacttaatcaatcactttaaatcttgaatacttaaaaaaaattattaacaaaaaattaattctaattttaaaatgaaaccaacttcctctttaatttttaatatcaaatgaaaaatggtttgtatgtattttttttctaaatttattatacttatacttatatttatatttatatatcaacaatttataagtttaattaatagttattttaatatttaattttataatcaatagtaaaaaaatgagtaaatattgaaataaagatatgatggttggatatactaaattgttagagacataagaaactactaaattatctgcatatatacatgaaagaaattggcatttgtaacttcttaaatgtaataattttttcaaatatttgaaattatagttgtaatgttttacgagtaatatttatgttacttaagagattttttaacattttatgctcgtatgttaaaaaacaataaactttttttataaaagaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgtgtaaaatcttttttttttttttttaaaaaggaaacaaggcgttacgaagaagggacagtttttataataaaaatattaaaatgggacaaaatgatttttgtaccatacatgaaagtgtaaatttttttattttttgacaatatttatcttgaaacttttttttaatctccactacatatttattcgacttttgattagttaaaattattgaatttgtaatacattctacaaacagttttttgcatcaaataatattattgcttttaaaagcaaggagaaaagaagatacaaatcacaatggcgctttattgattttttatatatattattaatctaaacagtatcacagtatcaccattagaaatcaattcaaaaaaatgtggaaggagtccaagttaaaatgaaactgttctatctatttataaaataaaatttagtattatttaatgagtttaatatttatgtactaattatatataataattttatgataatcgtttgaattattttaaaatattattttaaaaattaataaatttatcttgtatattggattataattaaaattatttaaatatgactatgtaatttttttattttttacactttcatgtataattttttttcttattttattataaaaaaattcaaaatggattaagtaataggcaaaggatgatcaggatctaaaaccaaatctaaacgacatatgggcagcacaaaaatttggcgatgcatgaaatcaaataccgtactttgttaattagtggattaaaatcaaatataataattgcttaaaatatcgttttatgccgcgatattgccttcagtttgttttgtgtggacttgatgatccaataaaggatatgttgttttgaacaaaatgatttcgtcatatttgtacgactgttttctaacaaaaacgtatttttttttttactttgttaattgatattttcttgcttatcttgcttttaaaaaataggcttgattatcctgctttccatatggttcttgaagtttcttgaactgaccaataagataaaccaaacttaatttgctcacattatataattatttttaaaataaatataaaaataagaacaaaactttcaataactccttaaatatttatcatcaagtttctaaaccatctacacgaagatgtgtttccgagcactaaataacttcaattttttttttttggtttaagtaacttccattaagaatatgtactggaattatataaaaataatccatttgatttgatatcttgatcataaaaaattatgagtgtattaggaatgatcaagaattatattgtttagagctaaattaatttttaagtcaaatttgaaattaatgtttagagctcaaattttaaaacaaaacaaattaatttttagtgactaaagactcttttactgttttacatggcaaaaatatttagtcatcgtatacgtagcgactgatttaaagacctattaggaattgaaactaaatgtttaaaaccaaaataaagttggtcaataaatccgttattgatgacccttaatttattcccttaaagaaaaaaatttagaaaccaatattttgcaccaattaaaataaattgagatcaatttctagttgttaatgaaccataattattttttatttagacattatatttctgtcactaattaaaatgtaattaaagagtgatttttcatttgcaaatgtgccttaaaatttctacacatcactaaccctctaactcactcacgaaaccaacactgtactgctgccactcacattcttcacttatcataaaatcacacttcacacatgttgattttcttccccttcctccgtaacgtacaaaatcatacgcatatgcatacacccatgaggccatgacagcatgcatagattaattcctcctgcatttattggtttgctactgtgctcctggctcctgcatatatatgcttcctttatctgcacgagtttttgttgttgttcgtttgatgcatgaaagggaaagcgttgctctatttaatcacgaatttaaaagtgttatgtatatggctttagtttagtctattcagtaaaaagggagagaagcgtccacgttaggtttcaataatattgtaaatacagataatttaattaataatgtaaaatattaacaaacaaatccttaaaagaaaatatataaacaaacaatataaaatctttttatccttagccttaattttctgtcaccgtacttttttttcctttctttttctattttctttagaaagtttctaacttaaaattaaaacaatttttaattataaaactcttttttatccgtagccttaattttgtgtcacgttattttttccttttaaaaggcttctaactcatgaatacgttagaaaatgaattcaatgagcaaggcatcataataagaataagcgggtttaatagcaacatgaatatgaaagaagaagaaacactgtgacactatcacataataatcttaattattattgataaaataactctaattcaaatatccggaattgctctttatgccaaacccacgaggtcttggaccatacccaccattgggtccccctccataaccgccacctccgggtccaccaccacgagacccacttccataatttccaccccccgatccaccacctccaggcccgcctccatatctaccacttacaggtccgccaccacttggaccttcacctcctccaggtccaccactgtagcttccaccaccaggccctgcaccacctgcataaccgccacctccggatccaccaccacctggcgccccaccttctaccgatccgccaccactaggccctccacctccactagacccatctccataactgccaccacctggccatccacctcctccagacccacctccataaccacctgcgggtccgccaccaccaggccctgcaccacttccaggatcgcctccataaccaccaactccgggtccaccaccacctggccccccaccttcttctggtccgccaccactaggtcctccaccatcgccaggaccacctccgtaaccaccacttggccctccacctcctccaggcccacctcctccataactaccaccaccaggccctgcaccacctcctggcccgcctccataactgccacctccgggtccaccaccaccaggccctacaccccctccgggtccgccaccaccgctaggcccacctccataactgccacctccgggttcgccaccacctggccctccacctcctccaggcccacctcctccataaccaccaccaccaggccctgcaccacctccataaccgccaccaccaggccctgcaccacctctgggtccaccaccaccaggccctgcaccacctccaggtccgccaccaccaggccctgcaccacctccaggtccaccaccaccaggacctgcaccaccaccaggcccacctccataactaccacctccgggttcgctaccacctggccctccacctcctccaggcacgcctccataactaccaccaccaggcccttcgcctcctccttgcccacctccgggttcgccaccaattgaccctccacctcctacaggtccaccaccaccaggcccacctccataactgccacctccgggttcgccagaacctggctctccacctcctccaggcccgcctccataaccaccaccactaggtcctccgcctcctcctggcccacctccataacctccacctccgggtccaccaccacttgaccctccaccccctccaggtccaccacttccaggcttgccactactaggtggtccaccacctccaggcccgcctccataactaccacctccgggcccgccactacttgatcctccaccgggccctcccccacctcccgatcctccaccaccaggcttgcccattcctggtataccacctccaggcccagcaccaacagggacaccccatccagggatgatactaccaaaaccaggaatgctccaaccgaagcaatttgacgttgaacagaccctaacaacgtctccatgacttggattttctctatatttcacatcactcacgttgtttttctctttagcaacttcacctacaaatgcatgaacgctgaccaaatgtcataatcacatatttgtcacaaaaataataattacgattaaggaacataaaacaagatttatcgtcaatgtagtccgttacaatgcaatgcataatcgaatttaattgcagtatatgagaattcaaagcaaaatgcaaactcacccgttgtagacattggggaggtctcagcaaggttcctagccgtcacgttagaggatataagagcaaccatggccaagaggcctagaatgagtaaggtttccttagaaaccatttttcagaacttaacaaaacaaacggaatttcaatgaatgtttgctaatgacgtatcgatttgaaaaacagtggggaagtggttctatatataggatgaagggagatagctggagttgagaaggatcccaacttgccaatttagcctaaataataaattcatatttctccaaagaactcaaaattcactcttctgatatcctactcaacgttattcttaattttcggaagtagcatttaatgttttttttattacttaagtagcattgaatgcttgatgaacatgactatgtaatgaaaatgaatacaaatattaaacaagtggttatccttcgtatcttgcattggttataagcatcaaagtcaacagggaaagataacttgcaatttgctataagtgcgtccttcagtttctttgactgagcaagaacaacatttaaaaagaataaatatcaaccaaatttaatttgctcaccccctttttcttaaatgaaatactattaaatcattataaaatttatggtcaagtttctcatatttttaatttcggccaaataaagttacttttaaatttaacaagagtttcggaatcaaatataatatagacaatctttcagattaaataatgtatgtctttgaaagaatgtattatgtttttttctttcttaaagaaccatatgtatgtcattattctttattactttaaggaatacacaccaaccataatttcccctccccccccaaaaaaaattgataaggacaagcatgtaaatttatatacatcacaaaagttcacataaatttaaatttaaaatatagtgggatatcaattaaaaattaacgtgcatatatgataatacaaaaattaatgaaaaattaaaatagcatttaattttatttattattaatattatgaataaggcagtccaaaattattgattattaatataaactaatattgagctttaaaaaaaactataagctatttggctttggatttttaaaaattatttttaaataatttttttattgattttaaacctttattacttaaagaaatatacaccaagcatgatctgcccaaaacggataaggacaagcacataaattatatacatttccaaaatttacagaaatataaatttaaaaatataatgtgcatttatgataatacagaaagtaattaaaaaaattaaaatagtatttaatattattaattattaatattatgaagtagcattcaatgtttttttttattacttaagtagcattgaatgcttgatgcttgtatacatcaacttaactctaatgaaaacgaatacaaatatcgaacgattggatatctagtgtgtcttggattggttataagcaacaatgtcaacagggaaagatactcccaccccatgccacccaaactataaggacaagcatgtaaatttatatatataacaaaagttcacataattttttaaaaatataatatgatatcaattaaaaattaatgtgcattagcctttaataatattaattattaatatcatgaataagacaatccaaaattattaattattaatatactagtattgagctttaaaataaatataaactaattgaattagaattttaaaatattattttaacataaaatctattttaaattctttattacctaacgaaatatacccaaagcataattctccctccccaaaactgataaggacaagcacgtaaatttatatacatcacaaaagttcacatagatataaatttaaaaatataatgtgatatcaattaaaaattaatgtacgtttatgataatacctaaattaatgaaaaaatttaaataatatttaatattattaatattatgaataaggcaatccaaaattattaattattaatataaactaatattgagctataaaaaaatataaactaattggattaatattttaaaagattaatttataataaaaaatcttatagattttaacttccttgttacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggacaagcacgtaaatttatatacatcataaaatttcacataaatttaaattttaaaatataatatgatatcaattgaaaattaatgtgcatttatgatgatacaaaaattaatgaaaacaatttaaaatagaatttaatattattaacattatgaatcaggcaatccaaaattattaattattaatataaactccttcaatgaatttagctgttcaaaagaaaaattattgcaaatcctccttttataagtttatgactatgagataatgagatgcttttcctttcagagcttgttccaattcttggtaaaaaaaaaaaaaaatcaaataattgattttttatttataaaaacattagtagtgtattaataatatttttatttattaatcaatattcttaaaactcgtactcattaatatttggcggatatatttatctttgacttctactaaatttacctaaaattgataaaactattctataaagatactaataactccactcttaaaaaataagcgtaaatgatgttatcgtcagcactcaattaaatttcatgtcatgaaattaaaaaaattattaaagatactaatatcaaaaacaaaatatctatcctcttcgaagacggaggctagggtacgcaagctaaacccaggcgtaacttacgaaagccatctgtgcaccgttggatcaattaatttttatttaatttaacttttttctttttctttttatggtgcatttcccgaattacccttatcttcatcgcaccgcacctcccagcttccatcccttcttcgtcttcctcccttcatcgccactaccgccccccccccctagagcccacgcagcagccaatggtgattccagcaacaagcaaccggtactcgcacctcttcccccgtatcgcatgatatggctccaatctgtcattgttgaaatagaagaaaaaagaaaacgtttttcattgtttggtgcagttttctgatttttctgagtttgggggtttttgagggaagggaaacttgcgcactgatgcgattgcggcggcaaccgtcatcgacttggcgctcaccggtgcggctgaacggtggctctcattctcgtgactgtaccttcaatttcttggcttttttggttgaacatgagtggagatgtcgtggtggagatcttgttcgcgggataccgacgagctctatgtgctcacggtgtggtgtggagctgcgaccgccatggctactgtaagaagctgctatgtgcatgtgtgaactccgctccgtcgccctctgccgtctccgaccccattcccgtcgcctgcgatggagagatggtggtggacggttgtcgatggaaggttttggaaggaacgcggagagagaagagaggtaaaatacaaagggtagaaagggaagattgagaaaaaataaaatttaaaattttaaaaataagaaccgtaggatgaaaattaaaacgaatccaacggtgcaggcaatctttcgtaagttacgcagaggtttaacttgcataccctagactccatcctcttcgaagcccattttttaacattagtatttaagccaatggcccaaacttcaaatcagtcgaagataacaaccttcttgttgaacatttcctttgtcatgacgatgtgaaagaagatggggcaatttttttttggaagaagtggaaacaatttttttattatcttgatcttcgttcattattatatattttatgatattttttaaatgttattaaaagtttttaataacttttttattaaatgttaaataaaaaaatattactaaaaaacatatatgtagtaatgattatgagtactgggacaaggagtctttgccttcctccatgtaaggttctatatatagatttgttaatatgtactcaccactttcagttgcagtgtattaatatacccaaagtttgtgacaaaaaccccaacacatctcttattttattaatttattttaagattattataataattaaatgttttaattttaaaattaaaaaataaaaccactttctgttcgtctctctccgtcgtttcggaattctgatccatcatattctcaaggaaaatttcagaggcaccatcaaggacctacttgaagaatacgataacacaaaccaagagagacaatggttgaagtcaattttgtttatctagaataaggaaatgcgacattgaattgaaaattaaattacaaaggaaatgcgttcatggttattatgggatttgcaatagatggtgaatattgaataatcatcttatcattcttatggagacaatttggaagtgttattcgttaaaggcaaggagtgccatgtgttgttgggtctaattccaatgtaaatcatgaactaaagtagcaattagttttcacaaattcatcctcatgaatatttcatgggctgtttgaatgacctttgtgataaacttggcttgttgttggtggtgagatgcattatcatgcagcgaaggcataatggtaaacgcaaatatgggaaacggtgtgagagaaaagtatattggtgagaggcagacgtaacgacacgataagagagaaaagtgggaagaagatttattttcaatttttaaaataaaacattaaattactgtaatggccctaaataaattaagaaaatgaaaataagtggtttcttttttgtctaatttttttatatataaaatgctaatacacaccaacttaaaaaatgatgagtgagtattaacaaatttcatatatatatatatatatatatatatcatgatagttattagtcgttaataattttaaattattaatgatattaatttttaataaatgaaagaatcattttaaattaatttgaaaaaaaaaagaatttaaataattttttaaaaataaaaatttaaactgaaacataaaattaagataaagaatcaaaagttatatttaaccaaacatataattaaatattataacttttttccaaaagaagtgagaccttggtgggagcagggataacaaaagtatatatactcaattcataacggatagaagatagatacttaaacaagtaactttatatattttaaacgggtatatgtgtacttgttaataaatgagagtataggcaattaagtatcatggtattagcttgcgtgtatccgttatagtaagaataattaaatttagtttctaaattgaagtattttgattagtataattgtatagaataatatttaagtaattttagttttttagcctttaaactatttttttaaataaccagttagaataattaaaagttatggttcaaattttcaattttaaatctttatgatgttgtttaaattttaaaaatgtgtttatttagtacttatttccgcttctaatattatgatgaaaaaggaggtcatgtgaagaaatgaagtgtcactagggaaaaaaacacaaatattactaaagtcacgttcacaataatctcaacaagagaaaaaaaaattattattgtttttctctttcttttaacttaatctactagttattttcatgaaaaaacaaaaaaaaattgttcaaaaaggtatctaacaacaaagattatccaactggccggaaacattattccaatattcttttcttttgaataaattaaacaagtcaactattatcctactcttttcgatccattattaaaacaatattgactaatgtaattaatatgacgatgaaaaatgcctaccaaaagtattcttaggactattctaattcatatatctctttcatgaccattttttgtaattcatcatgtgagtaatttctaatattatttcatgacttttcactttattttaaatttgatagaaaatattttaatacgaggtataaattaataatggaatacatatatgaaaaaatataattattaaaactaaaagtgtaattaaaatattgatgtaattaaaaaatagaaagagtttaaaattaattaaaatcttaaattgtaaatatccaaaatatgtttttatcaataagttaaaatttatatagaaataccatataatcatcttcatttctatcattttttacttctcacttactttaacaaataattttaataaacatctatgatttaataagtcgattttaataaacacctatgatttaataagtcggcttaatagttttcaactataaactattaattattggtaattagctagttttcgacttttagcttgctactttttgaattactttttcccaacatagaatatttacaaacttaggttaggcttgaattttatttgtagctgtgatctcattcaaagtgtttttttaggggaaattcattcaaagtttattaggtatatttaattaggcgaaattaaatgtggtattgaccttctttgattaagatttggttgctttctctatttcttttaatgcactggtacaataacacgtgcctacaatatacaatattgttatagtttttaattttacaattaaaaatatttatcttttatttttatttttacaaaatgtgtgttaataaatatgtatataaatatttaaaataagaatttacgtactaacatacattcacctattttttagttgaagaacattaacaaattataactaaaaaacattttaaaatatacaaacaatgtaacttgtttacgtaccccaactaaaaaaccaataagtgtacagtagcaaatactagcaggattttctaaataatgtataatcaatttttttattagagtagattaacaagttatatacttatgtatcttccttgtagtattgtatatacaatataagttattttgaaaaacttgagtaattttttttttatcacaataagattactttttttttttcctttgtgaaactacctctcataaaatctttgggtttatcttaataattacaaattgtttaaaaaagtgttaataattaaaaatgtaaaattttaaaataatgttagtaaattagcttcaaatattaaatacttcgtgttagagaaacttataaaaaaattcaaagaaaataaaaatggatacaaacttaccttatatagagataaagatacaaaaataaaacaaaaaacagaaagaagatataagaaagtaaaaaaagttgaaaggatgaaacttaaataaatttagaataataaagacaaacggaaaatttaagaaagaagaaaagttaacaattatataaaattaaaattctttaacaaaaaggaaagataaaccttttcgattcgttgcacagtaatactttttctttataaaattaaaaattaaaattctttataataaattcgtaactgaccaaaggtcctttgggcaaagtgaaccccagaacaacacccaaagatctttcaatcaaggtcatggattgagttctcactgcagacatggaacaaatgaaccgacagttattcaatttaaccataagcctgaaagccacacaaaaatgaaatcgtgtgaattggacatcacttgcgcttcataaactagttgaagtcatcgattattcaaacaaataagatattaaaaaaacaatttatataaaaaatacatctgattatttcgttagattctttaatgatgtatcaagtcattaaattgctaacttctcttgttataataccagttaatgttgttacttaataaaaaatattaaaagtggtaaaaaagaaaaaattcaggaactttgacggatcaaaacttagattagagtctaatatcatgtttggttcatgtctaacacctaaacatgcataaaagatgtggaaaacataagctattaagagttgcttctagtttgacgtgatagatggatgtacattatctttaatgtgatgctaaaccaaacatcagcataaatgcaaagaaatagtaaactcctccctttttttactacaaggatcaatttttgaaaattaataaatctattaaggttttgggtcattcaaaggaacaacaatttcaaaccttgtgtttaagttattgggctttcggcccattaggagtttattaataaaatgaaattattttataccaataataaatatatttttagcaaataattaaattagttaaagttagtggtaaaatgtgtgaaataattatctatatcattattatttttggcaacttaaagtataataagaaaacaaccacaattttacattagaaataaacgtgtaagtggatagaaaatattttgtaaattaatgtctagaaaaagtggttctcttaagtataattttttatagaaataatgatagaaaattgtaagtatttaagtatgctctgtagttacaacatagtctctgacctttgacataaaaaagaattattcttaatattatatagtaagaaacttagttaaaaaaattgataatttgcatcacctatagttattttttagaaaagttattctttttaaataatccaagttaagaatttagaaaagaagagatggataaataaattaaattaaattaaattaaatctagaatttatgcataaaagaggttttgtatgcatgttttattaattacgcgtataaaaatttctctgtactctggaatattttgacaatgtttattatcattgtatattttatgatgattgctgtgaatataatttgaggcagaagtgtgatatatatttgtgatcactaagttagtggtcttcaatctttacgagatttttctaatagtatatgatgaataacaagtcataggcatcccgtgttaggactataataagatcatgctgtacgtagtgaagcatgattgcctatgtttgaaaataacagtttggtgcactgcgtgatgaaaaacatgggcaatcattcaggtttaatttttagggtaaaggtactgagttttgaacgtacagataaaaaaaaaaaaagcctcagttaatgtcttaatggtacgtgttagcgcccttgagttgggacaaatcacataaatcgacttggtaaccgtgacccctctcagcatcacccagattggtgaaatgtacatacttgttgatgggttggaggatctttgctcaagtataatgactacaacatggatgtcagtaacttgtgccgggttatacgagctcccaatggttcctaatggttcctaatggttaagggtaaatcattagagatgagtatgaatccatacgtctagcagaggtttgtggttgagtcatgacaatttaggtcagaccttacttaggctcttgtattgtttgttttatacttgtatgttttaggttttaaaacttattgagaaaataaatgggctcgtgaaacctcattccttgttgtttttcttctgtatgtataaatgtgtatggtacaatgttggatttggctgtggataagaggaggaagaagtcgttattaaggatagtagggacgaaaaggacagaggaagacacttcaagacattcgcagttggtatgtgtaaagatatttgtgattaattgaaacaaattaagaaaaatgtaaacaaccggtgttggctcaaggcgtcacgtacggttaacaagtggcttccatatgtttacgcctaaagctaacattcaaatacatgtaaacaagtcgaacaatatgagaactgagggccataatatgatagtttcaatcatcgctacaaataaatttatagccacaacaacatttaaaattaatatgaacatgtttccctttctcttcctccacctcaagaaagcacataaagaaatatatgatcaagaaaagataaaatttaactacaaagaaatgacgaagatatgtagtaacagtagaagtaaaactcacgatttagaggacaaactataactttgtgcacatatatcataattttaatcaacattttcttattgggaaataactgtagtgataattaacaaaggttagagaaaagacaggcctccttgctgactatatccatgcctctcataacacgagatttattcttgaaatatattatagctacgtagaactacatgcagtgtctcattttttagtcttatcctcgttgacctgggaagccacctccaccaactccggggaagccgccaccgccaccagggaagcctccaccaacaccagggaagcctccaccgccaccggggaagcttccaccaacaccagggaagcctccacccccaccggggaagcctccgccaccaccagggaagccaccacgaccagcaccagggaaaccacctccaacacgagggaagccagcagcaccaccagggaagccaccacgaccagcaccagggaaaccacctccaacacgagggaagccaccaccaccaccaccagggaagccaccacgaccagcaccaggtaatccaccaccaacaccaaggttacccccgccaccagcaatggctaactctaacacctccgaggagatcaaaaggagcatggccagcataggaactattgctatcttcgaacccatctttcactctttcagtagtaaactacaacagatctactcaaattaatgagatatatctggtaatgaaggatgagaaaattagtcggaaatatactttatatataggagcgaatgagagagaatttgaacctttctcttaattggcaccgtacttagcgtatattaatttagtcttttctagagttaattaataacctaattgttctcgatctccagctcaatttccttctccaatttcaatggtaaagtgatgtaggttatgaaattgaaggacagtatttattgtgcgtaactacatgcatgcatgtatgaacttcccatgtaatgcaaaaatgatcagtggacaacttatttgacaattagtgcgagaaagagataaaaaagaagtatgatagttgatataatatgatagaaagatagagatatagaaatagtaagtgtaaacttaagtagttggttgagcatagcataataagatatggcatttgacaagtagaggttttaatcttacttatctccttaggttcatgtaaatgtaagtatctttataaaagttctttgatttcaaacaccatctccttccataaaaattttactatgaaaaaagaaaagaaaattagcgagtgttaaaagaagtgtttaatttagagaaatagaatatccacctatcattactcaaaaaagtggagaagcatacacctagtactagtttgctatatatcttaatatttttctgatttaccctaaagtataaaataatttaaaggtcaaagttatacatttttgctgcaaagttagataaagttctttaagactacaaaaaatcaacaaattactaataaatacactaaagaattttttttccccttcctaatttgatgctaacaaatttttaaatattatatatagattttattaattttaattttttttccttgcatttgttatattttttctaaccagaattacaattttattttggtaactaacatttaatacaagtcagctgaaacttcattttgaataaaaaaaataacacaaaaaatacttaagaaatggcatgtaattaattatttttcttaattaaacatgcttgtcaaataatacagaaaattgtatgtcaaatatgaaataaaataattaccatcgagtgcctagatgaaatagtgtgtacaaaagaaaaagaaacactaaaatgaattttacccattacagtatattttcttcaaaggttattttttaatattatccattgttcctattgaatggttttatacagtataactacaaaattaatatttaattaaagtggtaacttaaataaagtcttatttacccaatcataaaaaagtcattttacgtatataataacttaaaatagcttctttttttttttatcataaatcatggttatgaattatgaatattataggtcaattgtttttttaattaaaattttcaaaatcctcatcaaaattagttactaaacattttattattactttatataaagtcctgtacggagaatacttatgtctggtctttcatccaccacttaattataatgttttagtctcaatggatgtcctaagctcctagctacgctattttgaattaaaaacaaaaaaattaaaaagccaacaacatgactagagttttcctttttgtcgacagaattgtgctgtggcctgtggctaagagctacggcgttcactaaatgaaattacaatgtgggaaatattatcatgtttttcttccattacgtacacaagtattttaaacttaataaaattaaacacgtcaatacaataaattgttactaaaaacattgtatattattattaatcaatatcttgttatattaaatatgaatgaattaaagagagacatcttttaaaatatcgaagaggaaatatctttattaattaatatcatatcaaatttcaattttaaaatttaaatttaaatttaaattaggaatgattaagactttttctttttgtaataaaatcccgtcagaaaggcagtgcccattgcccactattgttgactcaggttgctactcctagctagcccccatcgcatgacatcgatattggagggggaatgttgccacaaaagtttgcccaaaagagatatatattaattggctatggggtttagctatgcatgctataggtttcgtgatcacattccagaaaagcatgtttcagcccacaactcgtcaattttgctgcacacaccttgcgggagccatagacggctgccctatatattcaagagcttgcccatccaagaggtaaggcttgattggactttctcaaaaacattgtacttgtcgatatttctagccctatggatgccaagagatcttgcaatcaaggtcctgaattgagggctcgcagactagcagcaagtgaacctagatttattgaaattttaccataaattaattctgccagaagccacacaaaaatgagagagcatgcacgaagaagatcacttgtccttggtccatagaggcctttcaaaaaagcataacacataaaataaacaaatgagattgtggggcccacatttggagagagatacccagggccaacttgggtgttgtctggagatgcacccaccactaaaagagtccaaatttcttttttaaaaattatatgtttgtgtaatatttttttttataatttataattttatttttgtaaatagattgaaattattgttttatctctttgttgttcaaattaacaagtaacatgtgattaaaaagtattatcatattagttgttagtttttttttttttttttaaacgtgctacctttataaattcttattgaatgaatttaatgaatttttaacttatcatgctattttatgatcaatgtaacaaaaatatatttttaatgaaattactgtctattttttatatgtaatatatatttattttcaaataattaaatacaaattaaacgactttatttagtgtttgttatggattcttcagttttttgggattggttcatgttcaactcatggatagtgagtgttaaacactccacacaacggataaaaagaaaagacgaaagagggttacaatgtcgaaggttcttgaatgggaaaagctctcaagctttgactcattctagaggaggaataacatggaaccccacacatgtacaccccatgtgttaagatcgacgatggtgtacatgttggaaatgccaaactctctataagggtttcctggatgaaatattaatcaattctgttataagttttttttaggtcaattttgattcaatcatgtctaggcttagtctgtaaaagacaatatacaaattagacaccattgaatataattaagtattttctgtctaacttaccaaccaaactcaaatacaccttatgaaatgtaaggattgaactttaaattttgagtatgaattaaatttggaccttttagcctagttccatcatggcttgatgtggccttaacccacaaaaagttggaaaacctctaatcttttttttccattctattttgctctcactttagatcatttcatcgcatcgtggtgtaaagagtcttatattcttttagtgaacttttaaaacaaaaacatatgactgataacaagttttaaaatagaaaaaaaaagcagatttactttttaaaatttgcaaaacttaaaacaaaaatcactccaaacaagacctaaatatttacactttaattaattttagcaatgcactctctcaaaacaatgtttctagctaatacattatcattaactaaaatttgttagaagttacaaaattttgtgagtctcaaacgatttttctaatacattatcaatattatcaatccactaatttagagaacaaaatcatttttatgccataatttgcttttaatttggattgtttttgtgtcatcaaaactgatgatagattccctttcatcaactgtggttgcagtgggtcgggtcccaaacccaagtaagaaaaaggataaataaaggaacggaaaaggaaagattatcacctgagaaactttttattttgcttttgtcttttgtttgcaattttgcatggaaaactttgggatcaatactccaattttcctttgccattcccttgaacttaaaatttagagtttgcaattttaccagtctttaaaattgaaaataaaaaaaaatgtaaaactcaaaacactactagaaaaatgattattagtgagggggatataaatttgtcacaaaattttttatgataaaaaaatttaattagagagctttattcatcattaaatctaatttaaattgtttgtgacatattttgtgattaacaatattgagggggatataaattggtcaaaaacctctcgctagatgttttatatttatttatgacggattttgtgacagacaaatttgaaaagaagatatttcataacaaatccctagctaatatttcatatttgttttgtgaggaacatgtttaagagggatacaaatccgtcccaaaattaaataaatttctgtccatctcaaatctatatttttcgtcagaaaggtcatcactgtgagcaagggtttttcacctctaagattcatcactaattttgtttattttctaatagtgatacaagcctaattgaaacgggttttagtttttaaaatttagaacaaacaattatcccaaactcttaccaacaacatattagtctcactccttataatgaagtctacttacaattttataaattttaacgagtttaattaacataagataatatattaggaaaaaatattaaatagtattttagtaactctcctcttattgtaaatagtagaaataatatatccgatcacaaataatgtcattaaatatgataataaatgaatgaataaataattatttttatcctgagagatttaaactcgtgataatttaatttttaaaataataaaattcttatttaatctttaaatatatataaaaatacaataattatgttttattgttatttcacgtaactattttgtcattaagctagctatagttggattttcttcatattttacattgtcacgtcattttttctccttagcaacttcagttacaaacacgtgaaacatgaacaagtgataatcatatatatttgccatgaaagacagtaatcatgattaaggaacataacacaagtgttgtcatgagttaaataggttataatgcaaatcaccatttttcagaactgaaaatacaaaccgaatcaaattaataaatgtttgctgatgacagctgatgaaatatagatatgaaaattagtgaggaagtggctgtatatataggaggagggagatagctggacttgaagtgaactccaaaacttgccaatttaactttaacaattacaaaataaattcagttttctccaagtgctgaaaattcgttttcctgatatcacactcaacgttcttcttaattttcggaagtagcattcattgattaatttgatgctggtgtcaacgtaattctgtggtcaagtaggtaaattaatctcgaacgagtgcatatatatctactgtttgttgtttggttataactaataaggaccaaagtgaacagataaaggtaacttccgatttgctataaatgcttttttcagtttcttggactgagctatcaagagcatttttgtagcagtaattcattagttgtttaaaattaagcattgttaattaataagtttttatcattaaaacatatgatttgactatattgcttaagtgaattgtttatatatataattattacttaattcattgttatcaattaaaaaaatcattttttaattataaaatttaatatgacacaagttaaacacttattctaataactttaacgttagagtaaatttttgtaaaatttctaaatatatatattattgtaagattcataaatttaagataaacaattcttttaaatagtcatacattatagatgttcttagaagaatgtttacacataacaaatatcaataatattaatttgctcaccccattttacttaaaaagaaaaattaaatcagaacaaaatttatggtcaagttatttatatttttccaccaaaaaataagttgcttaattatatttttaccataaaatttctgaaacaaataatgttatagatattaattgtttcatatatataatgtagtctttgcaagactatgtgttatatatgtatgtgtctgacttcatataatgtagtatttgtattatatttatatattactaaaattatgtgtattaaatatttttaaaattaaacaataataagaaaataattaaataaaatatttatattttgttaattttaatttttatgaatgagttagataataattatatattaatatgaaattttatatatgtaatttatttgaaagaaaagttataaaataatataaaaatgatcaaaattatacttatataattttatccctcctctctctctcactctctctgtatataaaggttttgcacccacctagtggggtgactgcgatctagggagggtaaccatagccagtgctagctcactgaattttgtatatattaataaaggaacaagcatagatttgctgtagctgcaatcaggttgaagatatggtaattataaaagctgaaacttatctacaaagaaatactgaagagattagtaattaacagcataaagtaagacacacgatttaattaggacaaactaaagctttgcacacagtatattatcaccatttttaaatttgctcttgatgataacttgattatgtaggtacatgcgtacgtattattcaacattttgttattgttaaataactctagctagtggtaattattgagaaaggtcaggagaaaacacaaccctccttgttgaccataagcatgacaagaaatttactgatgagatatagtaagaacgtagtagaactactctgtcatttgtgagtcttatcctctttggcctgggaatccaccaccccttccaccagggaagccgccaccaacaccaccagggaagccgccaactccaggaggggagccaactccaccaggaaaacctccacgtccgggaggggagccaccacgaccaccaggggagccaacaccaccagggaagcctccgcgattgggaggggagccaccacgaccaccacgggtgccaccaccactagggaaggtaccaacaatgcccgggaagccactaccacctccaccaggtaatccaccaccaacaggtaatccaccaccaacaccaacagggaatccactaccaccaccaacagggaatcctcgaccaccaggtaatccaccaccaccaccacgaccaggtaatccaccaccactaccaccaccaccaagtaatccaccaccaataccaacagggaaaccaccaccaccaggtaatccaccaccagcaccaacagggaatccaccaccaacactagggttaccaccaccaaagttacccgcaccaccaccagcggctaagacctccgaggagatcaaaaggagcatggccaacaggcctagggtaggtactattgctatcttcgaacccatttttcagtactaaactacaacaaattaattaactcaaatgagatatgcttggcagtgaaggatgagaaaattagtggggaagtatactctatatataggaggagagaagagagaagtagaacattgctcttaattggcaccgtagcgtatattaatttagtcttttctagagtttattattaagtaataacctaattgtgctccacctccagctccaatagtctcaatggtaaaatctaggctatgaaattgaaggacagtatttattgtgcctgactacatgcttgtatgtaatgcaaaaagtgatcgctggacaactaatttgaaacttaattagtgacagaaagagataaaagaaataaaatataagtgtatgtaataaaaaagatacagagaaagaaaattagtgtgttaaagaattgtttggagagataagaatattcacctatcatttttcgaaaagtggagaagtactagacatgatctagtgctagtttgctatcttaattttttttacaggaatcttaatattttatttatttatcataaagtataaaataatctaaaagtcaaagttagataaagttctttacgactattacatatcaataaattactaataagtatagtaacgaaaaattattattcccatactagtttttaggttagtaatttaaatgacggactttttaaaatttatatatagattattcggtgattaattttaatttccttgtattttcggtattgtgatttttaattaaaattacaatttcattttggtaacttaaatgaaattttattacaagtcaaatgaaactttatttttgactaaaaacaaatcacaaaaatacttaagaaatagcatgtaataagttttgtcttaaataaaattatatgtcaaataatacataacaattgtatatgtcaaatacgaaaactgattaccaccgagtgcctagatgaaatggtgtggacaaaagaaaaaagaaaaactaaaatcaattttacacgttacaatatattttcttcaaagttttttttttaacattctccattgtgattcctattgaaagtttttatacagtataacttcaaaactagtaatgtttatcaaaataataagtaaactttaaaattaatatttagagttgtacctttaattaataaagtcgtatttacgtgatcttaagaaaaaaaaggttgcatcttttttggtacaatttttttagttttatttacgtgtataacttttacttactttttaacataaaatcatggttatgagtttttttttaatgcatcatggttatgatatatatatatatatatatatatatatatatatatgaatatgatatcataggtatgttagttttttgaattaaaattttcacaatcctcgtcaagattagttagtaagcattttattattattttatattaagtccagtacggagaatacttatgtctgatctttcatccaccactcaattaatttttttatttttagtctcaatggaagtcctggctacgccattttgaattaaaaaaaaaaaaaacaataaaagttaagaacacaagttttccttctagtagacagaattgtgctgtggctatgagctgcgccgttttccaaggtgctaacgtcatatgaaattgcaatatgtgggaaatactatcacgtttttcttccattacgtacacagttttttaaatttaaataaaacacgtcaggaaataaattaataaaacattttatatttttgttattaataatgaataatttgttagagttattatgtggcaccccgataaagagaaacatcttctaaaatcgaagaggaaaatctttattaattaatatgatatattaaatttaattaggaatgaacaagacttttcttttttgtaagaattcaaaatgaaaataggaactacaacgtgacaacaggaggcatatccctgcccacatatccctccccaaagtctctaaaatcgtttcatggcggtgcccaccatcgacattggagaatgcaagagttgccacaaaaatcatagccctaaaaccaggaatgtatgctttagctataggtttcgtggtcacattccaggcaactatattttagcatctgatatccccgtttttgaccaaattatagccatgcacaactcgtcaattttgttgcatgcacacaccttgcgggagccagaattgcataggctgcctgctctagtcaagagattgcccttccaaaaggtaaggtaggattggactttctcaataacattcttaaagtctgcctaggttattggtcaccggccccatttgttaacaaattattatagtagtactcctttagtcgaactagatggtccagcatgggaataaggaccaaaagggtcttgaggaggctcgaatttaaaaaattgtcagtgaatgctttgcgtactagatgccaaaggtcaattgccaaaaatgagtaagtgtatggcttgtaaaagaaagactgaaaaccttcccggttaagagccttaaaggactttatttccatggttgcactcttaacatcctcttttgtgaccgaggccagtagtgcctcttgcgcttcttgctcagttaagaaatattaccaacatgcaacaggggccaagaatgttattagaaaaaagagatatgaagtgcctaatggctttctattataaaacatcaaaatttgtatgttaggaacctttctttagaaagagatcaaagatcttatattccgcattcaactagagattgtttgggcattaagaaaaatctagtgttctgtatgaggtaaacctgtgtgctacaacacaaaggtctagaagatcatagtagttaagtctgtttagatgtaagtttttctataaacacttctaaaagaagaaagtaaaaagaaaaaaaaaataaaatgaacttttccataagctaaaataatttttcattagttaatttatagatgtcatctcatcttttagaaaagttatattgataaatttctaaaaattaactaatgaacaacttatttttacttatgaaaaaattcatctcaatttttttaaaatacttctaaaaaacttactcaaacatgtcattggtcatattaaaaaaaatcagaagcttgttgtgggggagaatttacctcctcgcacttccgataaggttttgtaatttcattaaagttcaaaaccataacctcgggcgcctaattaaggcttcgacgaatattagtgagatggtcccattgagttaagctaacttgtagataaaaggaggcaaacaccgtgtaggcgtgtagcacacccaagtcaatgtacctttaattgttgacctgaaagtagatggcctgaaaagaaatactcacttcttttgtagtaaaggtttttcttttgtccaaatgcaaaacacccaaatgccaccagcattgccctgggcttcaaccagatgacaaacattaatgttttaaaaaaacattctagaatggctaagctaatgaaaatgagcaatgggttaccatataatgatgaatataggatggttatacctatgactcaactcatgaacctccgaaaaccattttggttgaatttattatttttcttttatttcctcttttttttttttttaattctttaatgagcttagtcatcattttgaactccaaattgaatttggactttttggcttcatgtgttatagtctatgacttgtgttgatactttgaccaacctaatttaaacacacctagtgaaagctaaggcttaactttagattatgagcatgaactaaatttaggtgtttttagtccgatccaatcacttgattcgatatgggcttatcccataaaaggctatacaaatgagacactatgaagcctaaattgaatgtgagtttttttgcctaacctgttatagcttgctacatgcattgttgtagtgaccaacctagcccaaatgcgccttattaaaaaataaggtttgaactttaaattttgagcataaattaaatttggtcattttagcccaattccatcatagtttgatataatcttaacccacaaaagttagtaaaagccttttatttttaaaaggaaaagttggtgaaaatcttaaatcttttctattccgttctattttgcacttactccatatgatctagtcacattttcatataattaaaagtctcacattcttttagtaaactttcaaaagaaaaatatagactgataacaagttttaaaaattgaaaacaagaaaatttaaatcaaaactaaaaactaaaaagtagtcttagctttttaaaagttttgaaacttaaaaccaaaaatcactacaaacaaggcccaaacttttgattcatatagtatttttatgctttttattctaagagaaatgtcaacaaaacaatgtcttagcaaaattttcctaatacatacattatatcaatgactaaaaattatataaaaaaaagtagtttcatttcttgtttttttttatatcacaatgagtattcattagctttgttttgcttataaccatctacattcgagaatatgtcttatcatcattagtaaaatttctttttaattaatcatatttttttcatttataatacttggattcaaaatcttgttcaagggatctaaattcaacttactgagaccaatgacatattagtaagcttgctctttatttaattaggtcaacttaattttataatttttaataatttttaactattaaaaatgaatatattagtgtttcagtagctctcctattattataaataataggaatagaatatcactgaagacaaatgtcattgaatacgacaataaatgaattcaacaagccagcaggcattaatataatatgggtttaattgcaacattgaagcccaagtaaagaaacgttattatttaggtaaaacgatctccgaaggtggaaacatttccactactttttgttcagaaaagtatcatacaatcatataattaacataattattgttgataaaaccacactaactatggccttcgggatgactcttaacgccaagcccaccaggcattccaccatatccaccacctccaggcccgccatcataaccaccaccagacccaccaccaggcaaaccgtttccaggcccgccactataacccccaccaggcaaacccattccaggaataccaccgccgtaaacgcctcctccgggtcctccactgtacccaccaccaggcaaacccattccaggtataccaccaccgtaaccgcctcctccgggcccgccaccataaccaccaccaccaccaccaccaggaataccccatccagggaagagacgccccaaaccaggaatactccaactcaagcaatttggtgttgaacagaccccaacaacacttccataacttggattttctccaaatttctcatctctcacgtcatttttcttcttatcaacttcagttacaaacacatgaaacatgaacaaatgtcataatcctaaatgtttgccatgaaaacagtacgtaattatgattgaggaacataaaacaagttgtatcataagttacaatgcaatacatcattaattgaatttaaagtttgtgagaattgtaagcaaaatgcaaactcacccgttgtagacattgaggaagtcccagcaaggttcctagctgtcccgttagaggatatcagagcaaccatggccaagaggcctaggacgagtaacgtttcctttgaaaccatttttcagaactgatgaacaaaagaaaccaaatcaaataaatgtttgctgatgaaatatcgacatgaaaattagtgaggaagtggctgtatatgtaggagggagatagctggagctggacgtgaagtggactccaacttgccaatttagcctaaatataaattcagtcttctccaagtcctgaaaattcgcatttctgatatcacactcaacgttcttcttaattttcggaagtagcattcattgtttgatgcttgtatcgatcaacgtaattctatgtagttaaattaggtaaattaatgtcaaacgagtgcatatctactgcatctttttataatttataagcactgatgcatagcgcgtcacgacatttttgtcaaattccatcgattaggggattaaaaagggtatcttattttgtattgtaattctaggaatatttgtaactttattttagaaattttttatattttgtttttttttttttacgtatttgttcatatatcttttacactcactctcacacacacacatagtttttctgagatatggaatgaatttctgttgtatgcatagcatttctagtgggaaacctaggatatttttttaattatgatgatgatatatgggatttgatttcgtgtggttgctctcacctcaagacaagcattggcttttgactgtttctgagggatgttatgtatatactttttattgttgtgcatgtctcattatcaagttcccaagaaacacattaatttctcattcagactgggtgatattttttaattaatttatgtatgtaaattaattgccagtaatgatctttatttgtgccattgaaaagatcaagtgggtttaatgtgaagattgtttctgttgaataaacttaaaatattagttttaatgggtttaatttaataattttattttaggaaaataaaatgtcatgagtcaataatgattataaaaaaggtatgataagccgcataccccaacggcccccacaacatcagcggccggacaccaatgtgagtcaataataattatagtttatggttatgaatgactataatgaattttgattgtgcattatgattattaatagaatttaagtcttttaaattcttgaaaaatatattataacttataaataaatcattatattgtttgacaaatagaaaaaagaaaaagaaaaagaaattgaacaaaacttttctataagttgttttctccacaaactctcacaacataatttttttctattttaaagtttcaagtggcacaaattgtcagcaagtgcattttttccatcaaaatggacgagttctgatgatccagaaaggtaacaagagtgatcaattctcttaattctcataggcatttttggtctcctatgttagtgcattattttttatttataaaattctcttaattcccaacatgtaaccaatatattagtgcattattttttatttataaaattctctatgctgccagatcttcttgtttagctgcgcaagagctgatagcagagcaacttgagaatttgctacctccttgtagtttaggtttgaattgtttgattgcttcacttgaaacatttaatataatgaattgcaacattaggaagaattagaaaattgtaatttcttcttcagggtattccattcatttcaatggaaaattctgcaagtaaaattgcattttctacattattggcgtcttaaccttcaactgtaggatgatttcatattgggaaaatctcccctttcttttgttctctctctctctctctctctctctctctctctctatatatatatatatatatatatatatattaatctaacaagattttatcagtactataggactttcaaatggaattttaaattttaaaagtagatatgtgaaatgtttcaaactaaaagtaaaagttgaaactgaaagtacgattagatatgcagtttacttagttttaaccataccattttgcccgttttaagctgattagttaaagcataagatgttcaatgtttgtttttgtttactatagaacataagatgtttactgtttattcatttccatattctcaattcgaaatgtatttgtttgtactactattaatataatatatgtgcaatctacctagtctccttaatgaaaaaaatatttatcgatcaccttatttgacttataataataataataaaaggtgagtcagttggcatgtgaaaattcaaaggagtatgtaaacctttgcacatatttagtgtaacggcatggattatttaatcaaagttcaatttgagaacttatataaaaaaggcaccaatttttttttatatatatgattgtatgagtatttatattaattgttaatagaagtgtcttaagaaaatttgaagcttttaatttgtattttaatattacaggagggaaataaaaagaaaaatatatcatatttttttattataaaaaatgtcattctacaccggttatgtaataaacgatgtagaaaatgactacaacatcggttataggaaaaatcgatatggaaaaataaatttcttgtaagtgttatacaacatcggtttgaaaaaattgatgtagaagatgtcatttctacatcggtttttttagaattaatgttgttttgaaccttacaacgttgattttttaaaatcgatgttcatttttgcatattttatatatttttttgtttatttcttatcatacgatattaattttcttaaaaattgatgttgtgtagtgtatgctaacatcgattttttcaaaatcgatgttaatattgatacttttaaccaatgttatcaaatccggtttggaccgggaccctgtggcctaaccaggccggttctactgtcagaccgattacgcaattgaactggttaatcccagctgagttggttacctaatctcggttagaccgattcgaccgaccaaattttttttaaaaaattgatttttttaattaggattttggagtatagatgaactctttttagtcaaataatgttagttatatacttatatataatagatacatatataattttgaatttttaatatatagcaagtcaaaccggatcaattactggtccaccgattggaccattgacccactacctcgatcggatcaatatccgcggaccggatttcacaactatgattttaatgtcagtgttttcaacattgattaaaaaccgatgttaaaagtctattttataatagtgcaacacttatttatttttatcaattcatcaacaattttttttatcatatcatatcacctatcatatttatattttttctcttatttcactctctctagtgtcaaataacttttggatatcaaaaaataattttcatttttaatcgttgtaaaatgtgtttgatttatttttttacttaaaacgttttagataacactttaaataataataaacattatctaaaaatgctttaaagatgaaaaaacaaaataaatatattttaaaatgacaaacaatttttttataggaacaaaaatgaaagttaatactaaattaatgaaaaagatatttaaacctcctaatattatatccaatgccattatcaccacgtctagagaagccaccactcctagggcgttcacgaatgcgttcacttaggtctgggcagcaatgtgagcaatgtccccaggctgtgtcctccccaccacagccacaacgaaaattccctatttctctattagggaaagggaaacccgcatgactaccaatgacaggccaacaaccaacaaaaatggcatcgatcacccgcttcattagtctctttgacaacctcacctgaaaacacattaactctaaacacgtaaatcatttacgatagaaagaaaaatgataaataatataaggagatagaaaaagatagaattaaagtgaacgtaaaagtttaagtataaaaaggttgaatgataaattgataattaattggaaataacatacaaaatgctggaaggagatggggagtcctttatgatccaccgaattggaccaacaacccattgtattgtaaacaacctttaaattaaagttctagtaacttcttaaggacgtgctaggtgggtgcatgctatgacaatgcaacctttcttcagagggtttgcttactgaggtggctgtgaagatccaaaaaagctagctttgcggtggcagaggaatctcaacgtgcagaggtgaaaggcttgtgtactttgttattgcaggatattgcaactccttcgtggtggctgatggatatggtagaaatcatatatatggtgtatttttgtgcagctatatatgtatttgattggtgggggagggggatattctgttgtgtagatcaatgggtaattattcatcatttaattgcacctttgcttctaaatgattgtttaacggattgctggtgggtttttgttcatcatttgtacttcttatgggtacatctagtacccttctttattgcaatatataattgttttgctgataaaaataataattaatagggtatagtatattttgtgtgaaatgacaaaataataattaatatataattcttatgggtacatctagtgcatctagtcatttctttcttttttgaggttttctttacaatttgcccccaataatgtgaaatgacaggcaggaaatggttgtaaagagcatttttacaatatatatcttaatgtgtgttcctttcgtgtagtaaaataaaaagaaaattacagtaacaacgtctcatggaatttgcactagttacatatccatcccctctcttactattatctccattttaacaataattggttttctccgtctgcttcatcgtgatcattaacatatatacttcatcttttagcatgatcatgcatatcttattagtaagcatattacttacatattcaagagtatcaatcacattcacattttcggtacttaatgacgttgacagattgacatcgaattattaatatacagcaagaatataggttgcatttttatttatctcaaacatttagcaacagtctggaagggtattttttttgggacaagataaaagtatattgatatgtggagtagtcccggacggatccagagatacatcaaagggagaaagctgattttttttttacacagttatttaaatattaagtttgtgataaataattatttaataataaatttcacaaaagttttactattaattgtatttgtaaaattagaaataagatctataatgagtaaaaaaattatcaaatcaataactttttttttttaaactaagaaagtgttgagggagaaaggaccctgcctgctccccttctatccgtcccggcccctaacccaattacataaggtactgcatgttttattatatataataataatagaagcaaaagtcacgattttaaaacaaaatatttgcactgaagattatttcaatttgctcttaaacttgtcacacaggcacagtgaagtacgtattattctacatcatttctacttgagaaaagacaagcctctttgcatccatgcctctcacaacaagagattttattcatgaaataagcacccatgccatgtatggcggttaccattcatgctggcagcaacttaagcaacctcccaaagacgacggaaaacaacagcctctcatgcaataccctcctcttccatatgtagggggtttgccaccaccccattgcccataatcataaccaccaacatcaactaatttgccatgacccacttcatttttctcttgaacaacctcgcctactgcaaacacattaattaaatattaacacatgaaccatttactatatatagaaaaattaattttgcacacccattaattgggtgtatatatatgatttgtgagggacgagaggaagagaaagaaagcaccaccaccaactaatttggcatcagtaacttcatttgtctcttgaacagcttcacctgctggaaacacatcaacccttaacacgtgaaccatttactatagaaaaatgaaatttgcacacccattatatatattaggtgtataattaagatgggtttaaatactcttgttattagccttttttttctttattgctgaaaaaaaattccaaaatgctctttataaaacctttatttttggtccattttgtttattattaattgcttaggtcctgtaatattttctttattttgaattagtccttataaaaaatataatacagactgaaattaaagtaaattattcagatattacaacgacaaaataaaaaaatattacaggaactaaaccaagaaaattataagaccaaaacaaaaaaaaataatagataatttttacaaggattatttggaaaagtgcaaggataaaaagtatacaaaaacacataattgcagggggggaaatatttaagtcaaaaaaatttataaaatggttacaacaaaattattttagaaaaatatatttaaaaaaaaatagctagtgtttttaaagcctttattaatattctattatttgaaatgagaaccatataagttaaaatgatatataacattataattaacttgccctcttttaaattcctggctgccacttctgaggagatcaaaaggagcatagctaacaggcctaggatcagtaaagccatctttgaacccatttttcagtactaaataaattacaacagatcgagtttgtttagtaacgaaagatgagaaaaattgtgggaatgtatactctatatataggagttggaggaaggagaagtagggaaacctctctcttaacatattaattcagaattttcaaaagtttctaactgatttattattatgtaagagtaccaaaaggtgttaaaataattgtaaccgaccattctatgatatccatattttatcagaaaataatcttattctaatattaattcaccaatcaccttaatgtcattgctgttagaatattacttaagcaagcatgaaacaaagcttgtacgtcagtgttgtaataataaaatctgagaatcacaatagctaataaatattttccaggcaacatgataataactagtattgatgatattattaaaataatagttgtaataactaataataatattatatacctttaatataaaaaatacgaaagataggaattttcaattccgaaggattacccttcagtttgagcaaaaggaaattatataacaacatactaagaaaagaatcttaannnnnnnnnnnnnnnnnnnnnnnnnnnnnnnnnnnnnnnnnnnntttctatatatatatatatatatatatatatatatatatatatatattaatattttatatcatcaaatggctaacaaccattcgacattcataaacgctgcctataaaatctgaagttcttttaataaatcatgaggcactaaatcagtatattaaaccattacttgtttctgatttgtcgggtgttcttttaaaaacttcagtgttaaattgtgcttagtttaattgaaggttattcgtaaaagaaatacatattttatgctactttttgaaggtcattattaaaatgtttaaaattttgaattgaattgtttagattaattatgcatagttttagttttaacttttttacacattttaattttattagaatgaatactttaattttttaaaagaaatcctccactgcctcaccctcaagtcgacatctccatgggtgatttctacaactgtaacattgctgctgcttcaatttgtttaatgatattggcaccttaatttgcggttggtctttgtattagaagtgattctggcagttttattttggctaaaccggtgttgcaccaaggctcacccccagcacatgaagcagggcacatgagtcagtttgagttgagttttgttaaatttgtgatacaatttaattaaatttgaatgggtttaggttattttttcaagaagaaaaaaaaaatcaactcatttataagtagtttgggttgagttggatcaatgagtcaaaatatttaaatttatcaactatttttaaaatctaatattttttataagttaaattttttattatatgaaataccaaatcattatttataattgttacatataattaaatagtgggaaaaaatgagagaaagaatcacattattaccaccatcatcatataggctagcatattatattaaacatgattaaaaaatttaaatataataaacaagaaacacacccaccaagccaaaacaatcccaaaaattaaaattattacaatatagtttgataatttcaatattctcaattaactaaaacttcaactaaatttaaaatagtttgaaataaattaaaaggtagaataaatattctataaataattttgctgtaaagatttgaaccacaaaatttgaaatataatagtaattaattttataaatttaaaaaatatattatatattataaatagaaataaataataataatttaaatacaaattaatagttcaatgagttggatcaacttgttcaaatattaaaatttatgattcaatccaaaacttaacgagttcaaatgatttgagtcagatttaatccaaaaaaaaaaaatcaatgtaaattatttagattaatttaaattaattcagattcacaaattatccatattgttgaacatcctgcatgaagcagaagccattgaacggttggaagttgctataattggctcaaagatcttaatttggacaaagttactttcgagctagacaacaagtagtggatgatttgaagtcatgtcatttccgttaacagaatttgcagctatttaaaaaattgtaaaaatattgtcatatttgcaaaatcatgtcattgatttaagataaatcaatcatgttgttcatctttcactatagcatcaaaatcttttgctagcctctgttctccatttgattccaaattgtattgagattcttattataaatgaaatgatataagttacttttgataaaatttgattttggttgctgtctttttaaattgatgaatatagtcatccaactttgaaaaaaaatacatgaatttagtatttcctccaatttgttgtgataaaaaatcatcactaaatattaaatttaaacatgtagaggaactaaatttccaactttttttttaaaaaaaatagatgattaaattcatcaaattttaagtataaagaccaaaattacatcaaatttaagcgaaagtatagaaatttaaaatatattttttgcatataatcgtaacagtgactgaacacctaattttgtgtgagtaataaacaccaaaaataaaaaataaaagtaaagaaaaaaaaagattagtttactccaaaagtataaaagttattcctcatctttattatttattttttaaaatctaataattctataatgaataactaatcttaatcataccacacaacttttggtaagaagtttaggactttttcctttagcatcgtttgattttgctagaaggcctcgccctcaccaacaggtcatctcacaccagaaactggagtttccctcttacccaatcttccctctaatcaatggtgacattaaatgaaatagattgaaaactagttttagaatatatcacaaaattcatttctttagttttagaatatattattatttaaataaatttaaaacttatttgtaaagaaaatagtatttttaaagtttaaaaaaatggtgtatttgtaaaaaccaaagtataaatataattaataatcgcgcacattcataattttccaggtagagattattaggtttgggcaattgttatttaattacacaatctaattttgctaatatatttttttataatatttttttttcagaaatatcatatttctggagaaacctttccaacatttgttagaatttcaacacattcaaaatacttttaggaagtgttaaatgtttaacatttttcggaaattattttctcgtagggatggcaaacgggccggcccgtaaaaaaacaggacggaccggcccagtctgcgaaaaatgcggggcggactggttcggcccgcttttgcaaagtgggctacaaatgctagcccgccccgctttaatgcgggctagcgggctaacgggccagcccgcatcaaaaattttaaaaaaataaaaaagttaattaaaaataaaatacaaaaaaattataaaaaaatacaaatatgataattaaaaaaaacacaaagttaaataaaagtaaataatttaaaattaatgttaaataaatgatgtcatgtgataattcacaaaattatatcatttgtaaatggaatttacggttataaactgtccaaaagtgtaatatgctagtaatgaaagactatttgaaagtatcattatcataaccattttaatattaaaacttagaagttaattatgagagtgcaaaagagtataaattaaaagaatatacctatttcaaaatatgttaaatatatttatttaattttaatatttaatatttaaataatataggcagcgggctggcccgccctgccccgcgtttggcccgcaattttgcggagcaggccagcccaacccgcttttgatttgcgggttgatattatcaacccagcccacatttttttgtgggctaaacgggccggcccaacggaccaagtccgttttgccatccctactttctcgacaccattttttagaaaagaatagaaaaaaacaaaggcaccaccaaaggggtaaactttgcagttttgggatagtccgtgacagtgttgcagtgaatttgaatgcttgtcatcattgtgattggagtatcatgcattaatgggattcatgtttctacgatctcttttagaatttcataattttttttttagctaggatttattctaaagaaatcaaggaagtgagtgtatcaacctatagcaaacgtagagcatcttaaaaggcaattagtgttctttttttattattctaaaaattggtttctgaaaaatattctctagaatgtgttaaatttttaaaactttcaaaaactactttcgaaatgtgaacattttaacaattccaaaaagtagtttagaaaaaagatatttttcaatataatatatatatatatatataatattaataaaattagaatgtaaataacattttttttctttcttcgttgttttcggccttgatgctggcaaattcatagctttggcctacattaagccattgtccagctatagatttttttttcttctttcattcatttgttcagccttgatgaggtgatgtgctgatattggctttttttctttttcgtttttctaagaaaaaggttttgttatttcgttatactgaaacattttttccatagcttttaaaattgaatcaaaccggatgagtttgacggcaaccagcttgttaaccaatacaaaaaaataagactattccaaaattagttagggcccatcatcaagaatcggtcaatccagtcaagaaccggccaatagtaaactcatattttattttaaatgggattatccactttagtctatatatagtagtattctctctaaatccgtatactaataataatataatatctataatacgatatctattattataaatttatatagtaatgttgcaatgttaattgaaaaataacattgtaatattatttacagttaataaaaaatatttaaataatatatcaataatatttttatgttactatttacatgaaaagaatgttttattataactattttattattgtctacacaaaattaaactgcttttatcttgatattttatttataactaatctagtaatgtatgaaatatcttataaaaagtattttatatgaaaatgagaggatttaatttagatggtataattatacataaaaaaataaaatttaatatgatgtagaaactaaaaaaagtcatatagttttttaaaaaacttacataatttcttaagattaaatcttaatagttatgtttaattataaagtctaaatttaatcctcttattttatatttctcacatataatatattctctctatatattaacgtgaatttatgaaaaagatctaggtcagtttgatctcccactcaccagaaaatggaagaaacatgggactgaatccaacctcaccttcttgcttaggttccgccaacaaagtttccacctcacaatttactggtccactatgtgaacaatttggggccaacattatctgccatatgttccaagttccaagttccaactccctttctcgcacgaaatttccctaaaccggcctctcaaatcctataccctataattcactgtaataggtcctcattcacctcaagccctatagcaccaaattaattaattctcttctccttacaatcctaaaatcttcctcaaaaacaataatagagagaatgaaggtaattttgtctttcacatatcacattcagcatcacttaatattgatgcatataagagttgtttgtgtaattgttacagatgcaggaattatatcgatcaccagtttttttccgatccacaaagtctttttttttttttgtctgcaaataaagagtgtatttctatttgtatatgtcaaaagtgatatcactaatttgatatctcataggtcctttctctctcatacactggtgcactcacacaaacacaaacacacacaaatttaatggggcgaaaactctctttgtattgataatagtctgccaaagccacactaatccctttacataatatgctatttataagcatttgaaataacctaaacaattcaaattttaaatctaaataatatctttcctaatatctttctataatatctctctccatatcttatctttccccatatcttttctacccatatcttttcacatatctttcacatattactccttttaaaattcaaactacgtaacaatatttatttaaacgtttatcctaacaaaatccccccataaactttaaatatttcttccgtctttcattcccatcatcttcttgcaattctccagcagcaacgtcggtagtggctttgtgaatatatctccgacttgttctcggctcgtcacataactcaactccaccttcttctcttttacttgatctcggatgaagtggaacctaacatcaatatgtttgcttctctcgtgattaaccgggttctttgctaactcaattgccgacttgttatctacccggatctcggttgtaccgacttgaacttgctccagcttctccaacaaattcctcaaccagactgcatgacacacacaccaggatgctgcaacgtactcggcttcacatgttgataaagtcacaattggttccttctttgacatccaggcaaacgctgtgtttcccatgaaaaatacatagccagccgtgctcttcctatcgtccacgtctccacaccaatcactgtccgagtagcccttcaacttgtaattttccgacttcgaatagaaaagtccttgtgtgatcgtcccttgaatgtaccttagaatccttttagctgctttccaatgagagtaactcggctcttccataaaccgacttataattccaacacttaaacacaaatccggcctcgtacacgtcaagtatcttaagcatcccaccaagcttctatagtttctcggatcaacacgttctcctccatcatattttgaaagttttgaaccgggttccataggtgttgaaaccgggttacaatctgccatcttaaatctcttcagtattccctttgcataactctcctgagagacaaaaattccatcttcatcctgtctaacttccaatccgagaaaatatctcatcaagccaagatcggtcatttcaaattctcttgacatcttcttgttaaactctcgtgccatttcttcactgttccccataaaaatcagatcatctacatataaagctacaagcaataaatcatcacctcttttcttaacatatatggcatgctcatagggacactgttcaaaaccgtcctccttgaaatatgcatcaatgcgggtattccaggctctcggtgcctgttttaatccgtacaaagctttcttcaatcttagtactttcttttcttctccaccctttaagtatcccggtggttgttcgagatacacctcttcttcaagtacaccattcagaaatgccgatttgacatccatctggtaaattggccacccaaactgagccacttgcgagatcaacaatctgattgtctccattctagcgacaggtgcgaacacctcatcatagtctactcctgccttttgcgcatacccttttgctaccagtcgagctttataccgttttatttctccatcagcattcattttcttcttatacacccatttaactccaatgggttgacttccttttggcagctcggccaactcccaagtatcattccgttcaatagccttgatctcttcatccatggcgctttgccatttctcatctcggattgcttcctcaaaccttatttcttcagaatctgtcaacaaacaaacaagatgggcttcgcttgttgactcatacaaatcctgcaaactcctcatccagggtcgtctcatctcgtcttcatcatctgtctcacttcttgccgggatcgaactcggtgatccgacttccttctcgtcttgagtaaccatctttccgggatttgatttgatctcggatgaaacacttcaattccattcatcgtcttcatttattttcacatctcggcttatcattactatcttagtgccgggatctaacagcttgtatccctttgtcttctcgtcatatccgatgaagataaacttcgtgctcttgtcttctaacttggttctttgttgatcaggaacatgtgcataggccacactcccgaaaactctcaaatggcccaccgatggcttttggccctccataattcctgtggagtctttccatttaatatggaatgcgaacagcggttctgtacatatacagcacacagaacagcttccccccaaaactcctttggcattctcttcgtcttcaacattgatctcaccatgtcaagaatggttcgattcttcctctctgctactccattttgttgtggcgagtatggtgcagtcaagaatcttcttatgccatactcctcacaataccttctaaatgcattcgatgtgtactctccacctcgatcagatcgtatcgacttgatcctccttccagttgcattttcaatcatcgttttgaacttcttgaatacttcaaacaccttggatttttcttccagcatatacacccaagttttacgactgaaatcatctatgaatgtaacaaaatacctctttccactgaaggacccgggagaaatcggtccacacacatcggtatgtattagttccagtggttgccgtgctcggtatttggccgacctttgaaatggactcctcgcatgtttgcacagcacacaatcttcacaaaatctcttctcacagttcattcttggcaatccgtccaccatattcttattcaccatctcggctaggcctccaaagtgaaggtgcccaaaccgacgatgccataaagatgcttcatcactcatctcgggttgcaaacagccgacctccacacttctcaggattaatttgaacattctattcttctccatctacactcgggctatcagtcgcccttgtttctctttcaagaggagaactcggtctgtcatgataaccgagtagcctttctccatcagttgtcccacactaagaatattacttttgagttcaggcacgtaatacacatcttgaatacgtccaactcgtccatctttctgcaagaagctaatcgtacctcggcctttcacaccgacctttgaagcatctccaaaggaaacatgtccggcttctgtttgtttcagattactgaacaaatgcttgtacccacacatatgattgcttgcaccagtgtctataaaccattccatctcggatgcatggttgacttcacctccagccatcatcagaacttctccatcttttacttcctctgcagcataattcgtagtttcattcgttcttctttcacctcggcaatctttcgcaaaatgaccaactcggccacagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatctaaataatatctttcctaatatctttctataatatctctctccatatcttatcttttcccatatcttttctacccatatcttttcacatatctttcacatattactctttttaaaattcaaactacgtaacaatatttatttaaacgtttatcctaacaaaaagtcaggtacaagtagttacctaattgacccgactacaaaacgggaatgtaaaagatagaagtatatcctcaccaaaggttaatatctattaatgctaaaaaatgcaacataaataaagattagcagccatcagtgttatccctcaacataaacaaaatcctgcaaagcttttatatagcttttaccaccgaaagatatcttcccaccctgcacttgaaaccaaaagagattgaaaaaattgaaccctatatcagctacaatatggctttatcaacattaaatgacagagaatgactcaagcacccgaatgacccaataaacgaataagccaaatacataaatgctgctgccaaatttcttcataaggtccaatcttcaaaatcagcacgtgatagaaccataaagatagttattccagcaaaagacatgtaaaccacttggtggaatcagtttgatccaaaaatccaagcagcagggctagatttccattgactgaatgtatagtcgaaccccccattaaagagaatatcatgaattacattatcgatattatttatgtgaaaccaaagaacacatattgtagcacatcaaatatatatatttctaaatgttgtttaatttgtgattgctgttaggagttgttgcttccttcaatgtttggtataagacttaagctcggtgaaagtctcaaggtgttgaaactttcacttggaatttgtgtttaatgtttcaacaccttttgagttgtttaatgtttttctataattgatgatctagaactttttcttttctcttagatgattttctcttttttctcctctcttatataaagatagcttgtgtgagagttgtgaagaaaaaggaagagagaaaatttgacaacacctctagagagaaatttgaaggtaaaacttttttatgaaagtttgagtgaatatataccatcattgtaggtgagatttaagtgtaacatcatttgttggtgaagtttgatattttgtacccattattttcataatgaaagtttgattttgaattaatgttatgaatttttccttttttgcattgaggaagatttttccacattaaaagattgtttgtgttctctatctctctcctttgtgcatttttattttcactttcatatttaatttttgaggaactacgttccaacaattgaattagggagtgttgaaggaatttattttaataaataataatggatattcagtttttgtattagagattaaaatcaatttgataattttgtaatattaaataattgatattaatttaccccgtgtctcatgataacaaatttgttacttaacaaccacacttttaagtacgaaaagacttttacaacatgtttagaatgagtcatacgtttgacgggctaggatatttatggaccacacacgattagtctaagtgaataattcatttccaatgaaaattttacatgtcaattacattataatttgttaattaattgacccttcatgtgtacgagaaattttttagttttataatagtacatatctcatcatagttaatattttaatttagtaacttaatttcttattttatttaaattaatttttaaataaaaaaattatacaagcaatatgtcgtcattaatgtagtaaaggatctattatcatgggaggactaacatgaaaatttaatgtattttttgtttggaagacaatctcgtttcgagttagataggtcattaatgtagtagaaggtctattaccatgggaggactaatgtgaaaatttaatgtattttttgtatatacagcgtatttttcatgaaaaacaatctcgttttgaattagacagcatcattatgaacaattaaatttttctctaaatatttaacatatacacaattgcacatcaaagacttaaacttcatacttttaattaatttggaatattcccaaatcaatttatccacacgctacaagtcaaaagtcaaaaagatcgatatctcattactgaaatttcattttaaggattcatattttccaacaaatactctttcatatacatatatttgaaggtcaaatctgtgattgtacatttgaaggttatttggtcaatcatataacatcatattgattgttgattacatatccttttggatcgagcttatatgacacgttagacatttaaaacttttgctttagtaagagttggctgattcatgctagagaaggtagccactcatcagaaatatgaatatatatggtcaagatacattatcccacatctgccactacaactaaaaaacacttctctcttcttgttcaatgaagaggatagcagtgtaagggtgaaagtatcagggtttcatagtctgaaagcttttttttttttatcataattaataattgtattgttggaaaagaatatatacatagtaaccatgatacgtacgtgaggggaggaacttagtatagttacatacaactacactacttggtcaattcgtgttattcggtacttctgatatttgttaataatataatttttctttgctgacccaaaaagaaaataactgtattgttgaaaattattttcccaagacgttgcagaatgtgttttcttaaaaaaaaaaaaaaannnnnnnnnntgttgaaaattattttcccaagacgttgcagaatgtgttttcttaaaaaaaaaaaaaagaaaagaatataagcatgttaaaatgtttttgagcattttgttttaaaagcaggaaatcaaaaccatttgttttttaaaaaaatgtatggcaaaaaaacggtactcaaacaagtttttttttaaaataaaaattattttataaaacacatcaaaaattaaactgctcatatatcttggtgattagttttttcttagcatcgtcgagctatttatacagactaaaggataggattgaattttatgtgtagctgttacataagctggttttctgccactaatcacatatatacgggttttgggctcccactgtgctcacgtatatataatttatactaactttgctgattaaaaaaaagcttgggcttgctttctgaataaaaagatatgtttgtaaggattatctataatgataagataatgataattttagagaaggataaagacataaagttaacaataaagaggatatgatataaatgatgatgatatataataacagtacaagtaaaactcacgatttatgacaaactatttgtacactagatattcccgtttgctcttaaacatataacacaagcacaacgaggtaattcatcatcacgattttcacttgtcaaatatctatccctcatgcctctcacaacatgagatttattcgtgaaatatatttttataagtatgtagaactacactgtctcattattaatttgtgaatcttaattatcttgagattgagcagcaccttaagcatcttcccattgcatcctgaacacaacagctgaaacggcaaaacgcttggccttggaagccaccaccaatattagggaaaccaccaccaccaccattattagggaaaccaccaccaccaccaatattagggaaaccaccaatgtaacccccgccaatgattgggatggaaccaccaatgtaacccccaccaatattgcctgggataacaccaccaatgaaattcccaccaatgcctgggatgctaagtttgctaacatcatgaataccaccaactaatttggcatcaccaactctattcgtctctcttactacctcacctgcaaacagattaacacattaaccattgtggatagaaaaatgaatcttgcacacccattaggcattaggtgtatataatttgctagggaagagaaagataagagggaaaaaaagaaaatgataaatgtgattgatgagaaagaaaaaagaattgaaattttacagtagataaataatattcagcttagggatttagaaaaaaattaaggtgtcacatgctaatataaagccttaaaaaagacaataaggaccaaaattaatgatattgtatatttttttagagattaaaatcgaaaaaatagttttataaggacaaaaactcaatctttggattttataggaactaaaaacatattaaacatgaaaattaataaagaaaaattaatattttatagtctatgaaagtacgtgttttttttttcttttcatccatgcaatttattttagaaatggtcattgtatattattttttttgttttgctccttattatattttgttttagttcctcaaacatatctatttttttgttctagctagtccctataatatttagtttattttcaattagtccttgtgaaaaaaaaagaaacaaaaagtaaattatccaatattacaaggacaaaaatgaaaaaaaattatctaaagatctaaaataaaataacaaaaatctaaataaaaataatatttcttcaaggatcttttaaaaaaatatttaaatacattttttgtcttttgtaatttaatgtttttcattttttatcttgcaatttttttatcgttttaatcattgcaaaatgtacttattttatttttttatccttaaagcgttttagataacattctaagcattttttttttacttttctaacattttaaggacaaaaaataaaacaaacacgttttaaactaaaatgagataaaaaattagaaggacgaaaatgaaaaaaaaatactaaattacaaaaacgaaaaatatatttaagctttaaaaaatgcataattatgtaacacatatttaaacaaatagattattaaaacatttataacaaaaatacattagtaatatcatttcataaatttattatgttttttttttttttgtagtttaacattgttttaaaagcttttattaatattctcttaattcaaaatactcatgagcaaataaggcaaaatgatatatagctcaccctctttcaaattcctggctgccacctctgaggaaatgaaaaggagcatgaccaacaggcctgtgataagtaatgctatcttcgacttcaaacccatcttccggtaataaactacaatagattaactcaaatgagatatgtttggtaatgaaggatgagaaattaggggggatgtatactctatatataggaatggaagagggaaaattgggacctttctcttaattcgcgccgtagcgtattaattcaatcttttctagagttaaaaaccgatttcttcttgatcatctccagctcaatttccttctccattttcaatgctaaaaatttgtaggctatgaaattgaagcacagcaattattgtaagtgactacgtgtatatgctatatttaatggaaggtagagaagtagacacctactttgataatttgatatcataatattgtttttatttattgtaaagacaaagttaaatgtagtttcccaagtatgttgggtatcgtttttaaataaaataaaattttcattttagtaagatatatatatatatatttaatacaagtcttttaagatggatattagtaaagtaatattttaattataattaaaaaatagcagaaaaatactttaaaagctataagttttgtgctatttatttaaactatacgtcaaataacttacaagtttgatatcgtgtttttacttaccatgcataaagtataaaattatttagcaattgagttggtaaaaatgtcccttagattgtttctattatgtaagcggacccctgatgggtctgatatcttaatattattttcttgtactgcattgtcatgttttaactaagggtcacaattcgtgccttgttttaataatattagtctttgcctttaaaaaaaaaaaagtattttcggttttgttttctaattgtagaactctatttcattaatgtatatgttgaccttaaatacgagcctttataaggtggattatcaaagtgatgcaccggatgcatgtaaaataatttaatattatggtttaatcataaattatttttgataattaaaataattattataaaaattaataaatatatcatatatatgatgatttgtttgtgattgaatatcaatgtaaaaatattttaaactaccaaaacaaagtctttttcctctaaataaaacggttatatgtatactcttatgatggaatatatatatatatatatatatatatatatattgtttttatgagcattactaacaaatgtagttgtcttcagtaccatgtgtagattttttgtgatgaatttcaaacacaaaaagttgtggatgcagtggcggacgcacacgggggcctggtagggcctaggcccccccaaaaataaaaaataaaaaaatcatcagggtttgaatgacagaagatagttgaggactgggatgattgacaaaagtgaataagtattcgaggtggtattggtgttccttcaaacaagagttgggagttatggtggaatgaggaacaggagcatctgcagcacactggatttctggggcggatatgtgagattatacttgacctgcgtttctttgtctgtcaatttgaattgggcccccatactcaaaatcttgggtccgccactggcagtggcggatgcacacgggggcctggtggggcctaggtccccccaaaaataaaaaataaaaaccatcagggtttgaatggcagaagatagttgaggactgggatgattggcaaaaatggataagtattcgagatggtattggtgttccttcaaacaagagttgggagttatggtggaatgaggaacagaagcatctgcagcacactggatttctggggcggatatgtgagattatacttgacctgcgtttctttgtctgtcaatttgaattgggccccccatgctcaaaatcttgggtccgcgactatgtggatgcatcgatctttgacaactgattgtgatggtgtgtgccttgttaaaaacggcaaaatcatttctctcaatggaactatcgaatttttgtatgcatggatcctcagttttcattttgaccccttgcttccatagttgaatgtcgttcttaaatatatgaggatctatcatattttatattgttcatttaaacgagaggataaaggtagttttattttcaaataaatttatattacacctaagttaagatagactacacagaaatctttacggggaggcaatataatctatatattaatgtcatacagtgtaacacctaaatttttactgtttttattaaataacattaatttcatctttcgtgagtgaaaacattaattcaattataaaattcaattaattagaatttatgtgagttttttggtaagtttcagccattgttctaaaagttagatcgactaattgactagtgtgacctgaaactagtctattgaccggtccattaactccaaacaacctagacatctcagtacttatcaaacaagtccaaaactgtggtagaaaatcaatttgaatcgatatatttttattttattttttaatttcatcaaaaatatttttaagataataaaaatgcatatttaaataatttacataaatataaattattttatcagttattattatctttttatcttataaaaatataatttcattgtttatattaatttacaatttttaatcttaatttctcattatttatattattttattacttaatctggtatagcacagtttgacgaaaaaataccatttgttcaatcatggtttagcctcggttgaaccaatacaatctgtgaactagtactttcatgtaataatttcaaatccggtatggaaaacattggcttcagctgttaaccaaattgcgagttagatagtaagatattctggtaagcagacaacaaaaaatctcataaagattaatatgattagaggtaattaattataattaacctgctgaatgtttttgaaatggttctaacattctaaaataaattaatattattattttatataatgtcaggtgtactttatacgagaagcaactctagactaaagaaacacttaattaatacttaaatccttcatttgacgtcttatggtataataggacaattatatacattaatcatgattagagagtgagattacaccttttgacgaaacatctttctcacatttggtctaaagtcttttagagaaacgattttggtgataaggatccaaaatcacatgggaggcaacactttctttattcaattaaaagttcgctaattcaattaagaaaatggtttgttttggtttttgtgtggagggctgttcaattatacaggtaatccgtgaacttaatttgattcaaattgatttaagttgaattttttgagtatttagattcaatccaatataactcattcaaatacgttcatatattaattgaattacgagttttaatatttaaatttaagaatccaactcattaattatttaatttgtttattacaaatattattattaaagtaaattacactaatcattttaaaggtttcatgaaataccataaaaattttctaatttaaacatttatagcagccttccttatagaaaaacttttcaaattaacaattaattaatataagggttgtcaatataatatttttaaaataattaagagattattatagttgtcgtagttgtcattattgttagtcataatcatcgtcattattattaaacatattaatactacaattaaaataataataaaacctgaaaataaaataaattctagttacaatatatatatatatatatatataaggtattacacattttttatatgaaacaatcctatttatgagtatataacgtaacttcatactcaaaacataaactgagatcaacaattagactaaaacaatttaatggcatttgatccacattcttagtaatcatatactttattaatatttaaatttgggttatttaattgtatatgtttttttctctaaattttatcaaaatttaaatttttctaaataaaaagttgatcagttttaatccttgatctttttgacccgtcaataattttattcattatcattaaatatagccttatgacatatcattatttttattattatttaattatattttacgacgattatcttcctaattgttaaaagtcttcaaaaaataattagctaaagcattcaaaatagattaaacaatttttgactgataaaaaaaaagccgattgttgcttgcctttatttcttatcaaaatcccattcaaacacatcacatggaattatttcaatcaacttgttgaatttattttcggagaccaaaccaagtaaaactatagaattatttcaagcaacatgttaatttattttcaaaaccttccttctgatcaaggttaaatcctttacagcggcactcacaaaatctgcaatctgaacattttcatacaattatgttaaaaaatttaaaaataagaagcatacatgaactttcttttccatccaagcaactatgacctcttcacttatctcgtgattattttcaagatcacattcacgcctttcaagcaagttccaaaattttggttgtgaaagaaaaatccctatttttcggttgctaaagatttatctcttcgtgaagttttttggcttagggtatttgtttttgagcgagtcaactccaaaatgattctggggttggaatcggtgctgatgaatcagtcgtggagaacgttcccgtagttaaggaggttctgtatcttttggttgagaccctcctcgccgattttcacggtggcgtggtggaggagtgtgtcgttgagccgccactgctgatggtggatacaaacacgaggttcggtcgagcttgatggagggggtgatgttgtggcgcacaatggcgtgtaaggtgagtgcaaagagagggagcgaagggtgcatttcatttgggagggttcttgagggataataaatgaacaaaaatataacaccaagttttgatctttccttccaagtcctaacctttccacaatctaatgctaatccatcaccatattcagaaatcacaacgaataagaaacacgaaccaacgataaacttcacggcatgccaaatcgacccacttggagagaaaactgaaaccgagctcagaaacattgacacgggaaagagtaacaactaaaagcaaaacccattgaaggaaaggccttcattgttttcattcacactgttttaatttttttatttatgtgtgtttcaaatggattttgttttgtgttttgaggatgtgatttgctgtttaaagtaatttctgatagtttcagcagtgagaagttaaacattaattaagtatttttttagtaattttttaccatcaaaaaaggaatcaccttaaaatataattaaataataataaaataataacatatcatttgttaaagattaatcaattttttattcacggattaaaagtgaaaaattagaaaaaattagagaacaaaaacataataactccttaaattttaataaggtaactccttttctaataacaatagcattgaaaatttttactttgtatctatgataggtaatgtaattaataaatctcattatatattgcctcttccacaattgagttatctttataaatattggttgtagtatacattcttcgtcgaccacgatactataatcgtttatttttgtcagaactaaaaaaaaaaaaaagattaggctatttgtatcacatccataattttggcccatattaagccgttgttaatctatagttttttttccttccattttttcagccttgatcgatgctgctatagactatagagtatagtccattaacacacgtttttttcggggtttttttttgtgaatacactttttattttcgttgattccacttttaagacgtaacctatttattttaaatgggaacaccttaatgaagtatgtagttaattatctccctaaatccatttaatgttgttttactaataatataatgactattataattataatataataactattattataatttgtatgggaagaggagttgttccaggcattgcagcatttgctagattcagaaaaataaaatttagacatgaatgacagatgtgtgtagctgttggaagcagatggggtgtattaattgagtggcttcagcatacaaaagcttgcataatagaaccaatgtgacacttctgaatgtggatgagacgctgcggtggaattcaccggttcctttaaaggtaattatgtgtttaaagggaattatgtgtttgttcttagttacatataagtgtttttaacacttgtagtgaaaaaaaataagatttattttgcatttaaaatatataataataaaaatagataaaaatatatttgtgtatccaaatacatttcttttgaagcaacaaaatttttctttaataatgtgaagactttacgtatattcacacagagatcaatatatgttattaactttttgatgagtgaaactctaaaaagcaaactatctttctactttttaagtctaaaattagactttgaacttttctattttgtgtctagtatattttgctcttaggtaaatacttttatttataatgttacatatatatgaatttcggcatttttcaaaaaggagagatttcacttaaaataaattcatatctctttatatttatatttaaaaataaaactatttcatattcttttttatcttaagaaacttctttatataagacaaagacaattatcaaataatcacatgactaattatgataattaatcacacatgatctgatctgatatgtagcagtagaatctcactcttattttatagacaactttcacatttataaaataatactttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaatatattttatttaatcaatgaatgacttaagaaatttttttcttctttcattaattattctaaccaaggtcttaattctatcagaggtcaaaactcattacctagagttgatggatttcttttttattaataattaattctacaagtatttaatcatattaaatattcattcaactagtactctaagatattaggtgtccgaaattaaaatataacaaataaattattaatcactatgataatttcaggtcaaagaaaactatatatgtcttcttgagaactttctattaacatattaatgcaatattaacaataagaaattttcaattaagtcagttcaacaatgacatccacatatacattatctatatatacaatttaataaataagatttattaatttttatccaataaagactatttcatatatattaatctatttgaattattgttgtcctattcagaataatcatacgatcaaaaataatatagattaaaattataaagaacttatttttcactaacataatctctatcctgataacaaatttttaattttaatcaagatcttgtcaaattaataatttaataaaataataaatatattaataaaataaataacaattttttaccaaaattaataattagatattgggtatatacatttattccaagcacttttctgaaaaataccaactaaaataaacttacggaggaggtgagttgtgggtaggggtgtgatatattggtatggggaggttttgggctgtgctgtaatgtttctatttcaattcttggattatgctgttctatttttagccactctgatacatcttctatcagtatgtttggcttattaatatatttttgccttttaaaaaaaaaactaatatcataaaattatagtaatgttgtaatatattaatttatattacaataacattgtaatattatttacggtcaataaaaataaaaaaattggttttaaaaccagttttgttttgagaatttcgttttaaaaacaggaaatcaaaagccaaattttaattaaaacaacatgattaattaaaaaaggtaaccaaacaagttatatatatatatatatatataatttaaaaaaaattattttataaaaaacatatcaaatagccctcatatcttggtgattattagttttttcttagcatcatcgagagataagaatgctcctaattataaaccaaagattagaattgagttgtatgtctgagatatcattcaaagtttatcaggcctttttagtcgagggaatttaaatgcagcattgaccttgttcaatttagcatcggcttgctaagttttctgctttctgaattcgattgtaaaatgacaatataattatagaaagacaaacttaacaacagggaggatgataatacatagtaccatgacagaagtaaaactcactatttattacaaactatttgtacagtagatatttgagtttgctcttaaacctatcacatagtacggcatattattgatcactaattctattagtgaaatatctctactggtaagaaaggtcgacagaaatgacatgcaggcctccatgttgtctatccatgcctctcataagacgagatttattcatgaaatatattattaagtacatatagaatcacactgtatctcatttatatgtaggtcttatggtcagcagcaagctaagcaacctcttgcatccccataacaacagccataacggcaaactgattggcctgggaagccctgacgagggaagccctgaccgggaaagccctgaccgggaaagccttgaccggggaagccttgaccgggaaagccttgaccgggaaagccctgaccgggaaagccttgaccaggaaagccttgaccgggaaagccacgaccaggaaagccctgaccgggaaagccacgaccgggaaagccacgaccagggatgccaacaccagggaagacaggactaggtatgccacgaccagagccttgcaaccctccaccaactaatttggcatcaccaactttacttgtctctttaagaacctcatctgcaaacatattaactcttaacacatgaaccattggaaaacgaaggggaaagatatctaggtttgaatctctcactatcaaaaattaaacaattaataattaatatttattgataaaaaaaatacataaagatagggacaggtgcaaaagagaaagaaaatgattaatgtgtttgacagtgagacaaagagatacaaaaagatataaagtggaaataaaaattgtaagttttagaaaatgttggatgatagaatggaactattccgtcagtttttagaaaattttcatttatgtgtttttaaatctcaaaacaacattaattattttttgttaattaatttaaacaacaagtttttttctatcatattaatctacatatttattatgaaagtagaagtgaaaataccactgatatatatttattgtgaagaagaataaaaaaatatatgaacaaaaaaagatgtaatagaaaacttaataactattttataaggaaaaaaattattgcatgtataaaaaccttaaagacaataataagttggaaaagatatataatgccagaagggggggggggtgcattttttaccaaatgaatagaattatgcatgcatttaaggacaaatatatatatatatatatatatatatatataatccaaaaaattataaaatgtttataacaaaaatataaaggtagctagtatcgttcttttcataaattcatcatattcttaatttttttaactagtgttttaaaaaaatttattaatattctcttactttaaaatactcatgacatgcaagagaatagaaggcaaaatgatatataactcaccctctttcaagtccctggctgccacctctgaggagatgaaaaggagtatggccaacatgccaggaagaagtattgctaccttcgttttcgaatccatctttcagtagtatactacaagtctacaacagatctactcaaatgcaatatatatgtttggtaatgaagggtgagaaaattagtgcaaatgtatactctatttataggaggggaggagggagaagttgggacctttctcttaattggcgccgtagcgtactaattcagtcttttctagagttaattaagaactgatttgttctggatctccagctcaatttccttcattttcaatggtaaaaagtggtaggctatgaattgaagcatgtaccgcaattaattattattcgtcaatacgtgtatcaatttgctatgtaatgaaaagtggagaaatagacacctactgtagtttttttatttatgaaatatattgtagtttgtttttacataccataatatcatttttatatattataggtagaaaataattcaaaggacaacgttagatacgttttcttaagtatttccgaatttgttttctaatgaagattcaaattttattttaattagtatgtaataaaaatagaagaatgtgataaaaaaaaatatttattttagtaatctgtataccgactttacttttaataagagtctttaaaaggtagaccaccgaagttaaattttaattctaaaccaaaaataacgtaaaacaacttaaaaaaatgtatttggacaaggaattctaaagaggtcattcatttttatagagaatctaaaatgtgtgtgtgtacatggaatttagaagaaatcaagaaatttatgaaattattttcactacttcacactaatattttagtatatctgtacattgcacagaataaatgatttttttaaactaaaatttataataaataaatattttaaatatataaattataatataacttttttacaagatagattatatttaattaaaatttataataaaaaatattatatcaaattataactaaagatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcatatgtatattaggaaaatatttaaattatgtagataatatatataggatagaaattcagttcatatatgtatgttagtttatataggatagaaattaaaaattaccctaaatttaagaaattcaaatttagttatacatccaaacaaatcattttaaaaagatagaaaaaaagtcagtaatttaaatttcaaaacattccaaattccctaaaaaaaattaaatttctagtcgaaacacaacatcagttttgtcctagtttaaacttgagttaaatattttattggtcttctaaaaataagcaaattttagttttgatttatgctaaaaaagaatgttatatcgttaaaaaaaattgaaaccattctttctaattaccatgtgtgacccgttaactacatatataatatttaacggaatattagatgaccatctactgaaggatgctcaactctgagttattgagcgaaatttatttattaatattaaaaaaatcaattaaatggatacaaataattaatgtgtcaaaatgaaggttgaatcatttgataaaaataattttttgataaattttacttatcttcaaagattatattttttttcacttcatttaaataagagttgtatccatatggaatttttctgtttcttagtatgatttttatcatcatctctcgttgaatttcggattagtagcataaggattaatatatctatatatatatatatatatatatatatataataacatttgttatcaaacatgtgaagataaaaacataaatgttaaaatcataaaaatttaacctatctaatcaaataaattacataactcataattgtcttttatgtgatcttatattttaaaattgtctaatgataatctcattgtcaatgctattgaattttcactagaccagttgtcaaatttccaaattcattgccaaatttccattaaactcatcgtcaacttatgcttcaactagttgccaaaatcattaaatcaatagggacaaaatgttactctttgtaaatgtgttctttgagtcttatttcgataattaattagatgacatgttaatttttattcgctggagagtttgaaaaataaaaagaattgaaactcagaaattgaggataataatggattcaaatatatataaacatgagagaaaaatacaaaagctctaaatatatatttataattttttcaaagtctagggtatatttacacacttccaatcaaggacggatccaaggggataagcatgggttttctcccaagactctttatgtataatgagaaaaaaaaaggaaattaaaataaaaatgctaatagaggaaaataaataagaaaaataggatttttcatttaatattttctaaaattctttctaatgggtccttttttagttttaaacataaaattaataataaatactttttataaactaaattatcatttattaaatatctatttattagaaattaaatattaaaataattgtataaaacaaaattcgtccccatttataatacattcctaaatccatctctactcttaattcaacataggcgtgaccattttgggtgggatatgttagtgtctatgctaccacattcaacatattacacttaatttgaaaagaaatctaaaataaatgttatttatttatctgaaaatgtatgttaaggaccaacatagcgatttttatattttgcatacataaaactaaggaaatattttttacaaaaagtaaaaataataatttcaaattctagaagaaagaaaataaaatataaaataaaaaacctaaataaaaatttattcattttatagaaacaaaaatcatatttatctttttaatttaatcataaaatgccaaaattaattaccaccgatgggtagatgatgtggtgtgggcagacaaaatagagaaaacacagatcaattaattttacgtacacgttacaatatattttcttccaagtttgttttttcaaactctccattgagaatcctcttgaaattaacttctgcacagtataatttcaaaatttatttttagaatagtaacttaaaaatgtcttgaaattttcaataaagtcgtggcttatgtattatttatattcttttataaaagtcgagtaattaaattttttattataggtaaattatttttacattaaacttttcacaattgacaatcctaaacaagaatgattagtaaataatttttattgttttataaaaaaatcaagtacggaaaatacttatgtagggtctttcatcctacctccacattttaaaaaaaaataggtttatacaataataataataatatattattattattattattattattattattattattattattattaaatgggtttttatgaactagcttttttaaacaataaaaaagtagaattataaacatacccctctctctatatatagaaagagagaggaatgctaacagtttactccttttaaactcaattataagtcacacaaagcttcggtgaactcaaataaaagtaattgttaattacttaccctatttaattatataacttcaaacatggcctttaaattaattaattgagagtatatttcctaagtcttgaagaggtagtccttaacataattttttaatacactttattactgatttaattattgaaaattataattttttgtatgtctcacccttttatttagtttttaataaatttaattaatagcagtagattgtgtattggaaggagtgttgtcgattcacacaaaaaagaaaggaatgattgttgttgttagcatccctctctctctctctctctttatatatatacactataaaaaaaatgtttagcgaccgctttgtcgctcgctgaatcattaaattcggttgctaaaatagttagcaactgaaatgacaaccgaaatcattttgtcgcaaaaatcaagtccctaagtccttagtcaccaaattcatatttgatcgctacttagtgaccaaataactcggtggcaataaaataaaactcgattgcagtgtatttggttgttattttgcttggcaccaattctgcaatcgaaacatgtaaaagtaaatttggtcgctaacaattaataaaattttaagcataaaataaattaaactaatattcgatttctatttttgtcgttattgaataattaatttaaaacaaattttaaaaaatttcattcggttgctaattttggtggctaagttataataaaatgtattgatataattcggtagctaacttggtcgctatttaataattaatttcagaattaaaatgcagtttggtagctatttgatttttaatttttaaatataaaattaattgaaaatacaactttggtcactaaaggaaaatatgcttatttttttccttttcatacgttacaatttgacttgctcaataaatattgactgtaaatataatttttaattaaattgtataatcaaatttataagtaaaagtggacattcataatgtgtaaataaatctattaacaaagttctaatttaaatattgataaagttcaaattcaaagttttcaaagtttactaaaatgcaatgtcggagaataataaagttcaaattcataactaatatgacataatcaaactaaaataaactataatcaggaatcaatggtcctttgacatatcatgatgacgatcaacctgagtatcgtcaacatggtgcacaattccatccgctgtggtagtcgatggattaagtaggggtgtttgcgggtcgatttggatcgattttgaccaaatttaggacccaacccaatcaaatttgatcggttcggtttggttcgattttcaaaagaaaaaaattgaaactcgacccgttcatgaacggttcggttcggatcatcgggttatccatttaatttttttaggactactattttatatcacgattctttcaaatattctatacaattaacacaatattatcaaatgtatgaaaatagtaaaattgattcatttaataccatcaacataatattctaaaatagacttataatataaattaaaacaaaagattttgaacaagatttactataatagtctgaatcacaattatttcttacaaaccaagctttgttataaccaatttattcaagttttataatcaatttactataatcgatggatagattaagagttgacatgatagactgaatattcaagtgttgtaatatacattgtatttgctaattttgttgaagaatttgctcaacatcaattgcaacatcttttcctcaagtgtcttctccatatctgcctttgccaaaagctcagcatttaatttagtaattatctcatgcatttcctctatttggtgttctacaagagcaatataaatagatgaagctgattttgagcaactaaaccttttgctcaaagtacctagtccatacacgttgcccttgtaatttggacctcaaacaacatcaaatatatttcattatcattaacagaagtacgagtgttaggagaatcttgtgtagatgtacgtttctctatcgaatattataagattttgtctcgatgatgttgatatttctcctacaatataaagtgagatatgaagataaattattaatgtataaacatataaggattactattcaagaaaatcaccactaatacatgaaaaaaaaattgactttaatctactatagtaggcttcaaagtttatactagtcaattacaaacattttaaataattataagaaacaaacaattattttgtacaaaaactaattaaaagattataaataagtatgattttttatttatcttaataaaaaatgtaaatattggtttgttaatttaaaaatattactaatatattatttcaatacttttcaaagtaaaaaatgtatttaagtatatgatattttttatgatttaaaataaattaaaatttagtttctaactatttagaaaaaacacattttttcgctaattcatcgctaatcttagattgtaattaaatagcgaccgagataatttcaatcgctaccagcataccatagcagctgaatactttcagtcccaactttaagtcaatcttcggtctctataatactattttggatacacagcgatcaaattgatccaacacttcgtttcggtcgctgacacaactaggtcaccacaataaattttggttgcaaattcgctctcagttggcgacagaaactttcaatatctattgcatcacgaatagcgacctatagttttcgatctctaatttcggtcgctaaaatgcatttttctagagttgttactagtattatatatttgcattttttaaaagaggagaatcgtgtatttatcacaaaaaggaagacaatataatacttgtaactttttgaataaattctattcacatcctctaagattttatcttattattctcgtatccttcctttattagtccttacaataaactctttaacagtttacatgttattacattctttcccacatgctctaagttctaagcttcaagagggctttaatggtgggtgaagaaaaatctagttccaaacccttgaatcttgggttgaagatgagagaaattgaaagaaattcactgagtgtgtattgtgtgtctacggtgaagagaaagaaaagaaagagtggaattggcttgcttgataagttttaataagaattgccaacttcatgacaagtggccaagtaatttgtggtctagaaaaattatagttagatttaatttagttgtaattgttgatgattatccttaacaaactcaagatcattcctatgtaatgagaagtcaactaagttaccattttagttggagtaactaaatattataaaagaaaaagcatagaaaaattactttttgttacttattataattactaaaactaattatgtaatttaatttaattttttactttgtaaattattagaacagcagagaggatgatacatataaacggtgatgatatatagtaacagtagaagtaaaagtcaacatttattatatgacaaattatttgtacagtagataattgattttactcataaacttaatgacacaggcacaaacgagcgacgacgtaatatatattcaacatttattatatgccgctatccatatgtgcctctcataacacgcaagagattttattcataaaatatgttattataagtacgtagaattacactgtcgtctcaactatgtatcctctgatagctagggcatcaacaccttaatcaagcttctttcactacatcatccccatctcaacaacctttacggaaatcctcctgggatgccaccaccaccaccaaagccagtgcttgggaagccgccaccaccaccaccaccaccaaagccagtgcttgggaagccgccaacaccaccaccaccaccaaagccagtgtttgggaagccaccaccaaaactaggagtgaaagggaaaaatggattcgaggtgggaaagccgccgccgctgccaccaccagggtagaatcggtagccggggaagccagggaagaagccggggaagcgggggaagccattgaagccgaagcggaagccagggccaccaccaaagccaccaaagttgacgccacgaccaccagacaatccagcaccagtgactggggaagccaccaccaaggtaacaattattatgatcaaaagaatataaccccttatattgcaaacatcttttaaattcaaaggttcggtatgaaggttttaaggatatcaaataaaaattaatcaatacaaaaggattaaataatattttgttaattagtatatgtaactacacttctttttgtttttcattcctgtcatttttttaaatggtcatcctaattattatttttttcattttggttctttttatttggttttagtcctcaaaatatattattttagtttttataatatttagtgtatttttttaattggttggtaatatttactgtattttgaattagtctctttgtagaaaaaataaaaaagcaaattatccacaattataaagtcaaaaacaaaaaaaaaatttaaaaaattcaaaacaaaataataaagaccaaaataaaataaaaattgcaaaaggatagtttagaaggaaaaaatttaagaacagaattaaagcaaaaatataaaaagaacatatagttacaagacccaaaacatataattcaagtgaataaagaaatcattaaacattcataacaaaaatatattagtaatgtctttagataaatttattatagtttaattattaacattcttatagtttaaactactgaagagaatataaggcaaaataatattatatagctcaccctctttcaattctctggctgccacctctgaggagatgaaaaggagcatggccagcaggcctgagataagtaatgatatcctcctcttcgaacccatctttcagtagtaaataaactgtaacagatctactgatcaaatgaaatatatttggtagtgaaggatgagaagattagtgggaatgtatactttatatataggagagggagggagaagttgggacctttctcttaatttgcgccgcaatgtattaattaattcagtcttttcgagagttaagagccgacttgttcttgatcgtctccagctcaatatccttctccattttcaatggtaaaaagctttaggctatgaaattgaagcacagcaattattgtacgtgactatacgtttatcaacttgctatgtaagtagacacctactgtagtatgctatcatatataaaatcatttttatatagcataagtataaaataatttaaaggactaaatcaaatatattttcttaagtattttcggagggtttgctttctgattaaaattaattaaaattttattttaataatctatatatacggacctttaatacaaagtctttttaaaaggtgggttacaaaagttaaattttagttttaacaaaaaaaataatttaaaactatacagttattaaggggattacaacaatgtacaatgtacatgagttgttacaaaaaagttatcatgtgtatagtgtaaagtaattttaattttacagtgtcataaatcaccattatgataaatttgttaacatctacaatatctgtttatatattttttgtcttaatcattccatttattagaagaaaaaaaactttgactaatctaaaatttaatcaaaaagtaagtaaaatttgattaaaaattgtttttttaaagatctaactcgattacaatctgaattatttaactttgactttaagatattaatcacttatatctaattgtttgattaattgtttatatgtttaatctaattttaggtgactgtctagtggtgaatttaggatacttaattaatggggaaattacttaaaataataaaattaataataataataattatcacacttataaagataaaaacataaaggttaaaatcataaatttttaatgtatctaatcaaataactaacataacatataattgtcctctagtaatctcatgttttgaaattgcggacccgttgtcattgttcttgaatttccattaaaccacttgccaaattgccaaatattcattagactcattgtcaactcatacaccaatcaattgtaaaattcattaaatcaaaatggacaatatttcttaaagaatttccaactattctttgaggaaattatgttgtgcatgtannnnnnnnnnnnnnnnnnntttatatatatatatatatatatatatatatatatatatatatattatatccttaggatgatatgatgaatttgaataatttgggaaaaatattatttcagttcctacaagtatgaagtatgggcaaattagtccctaaaacaaacaaaaaatcaaaacacttaagtttctaacatgtaaaaaaaattctaaacttaattacatattattattttaatctttaaatatatgttaatattatttaagcacacggctttttaaatttgatttggactacagttattgatctatatatttttgggtactcgaatggtattttacatttttaagaatgctagagaatttcaaaagcaagtcaaaaaatttgagataacggattcaaataatatatatatatatatatatatggaaaacaaaaattctatatataaacttataattttttcaaagtcagatgatgcaattgcgcactcccagttcaacatatattttgttgtgactatcccaagttgcactcattaattctatatatatacttataattttttcaaagtcagatgatgcaattgnnnnnnnnnnnnnnnnnnnnnnnnnnaatatatatatatatatatatatatatatatatatatatatatatatatatccttaggatgatatgttgaatttgaataatttgggaaaaatattatttcagttcctacaagtatgaagtatgggcaaattagtccctaaaacaaacaaaaaatcaaaacaattaagtttctaacatgtaaaaaaaaattctaaacttaaatacatattattattttaatctttaaatatatgttaatattatttaagcacacggctttttaaatttgatttggactacagttattgatagattacaccgttgggtacattttcttttaattttcttacttttaaattgttaatgtgacaacactatatatttttggggactcgaatggtattttacatttttaatttgctagagaatttcaaaagcaagtcaaaaatatatatatatatatatatatatatatatatatatatatatataaannnnnnnnnnnnnnnnnnnnnnnnnnnnnnnnnnnnnnnnnnnnnnnnnnnnnnnnnnnnnnnnnnnnnnnnnnnnnnnnnagtcaaaaatatatatatatatatatatatatatatatatatatatatatggaaaacaaaaattccatatatatacttataattttttcaaagtcagatgatggaattgcgcactcccagttcaacatatattttgttgtgactatcccaagtttcactcattaatgtctaggataccatgtctgtatatgacatatgtaattttttaaattcctaacatatatatatatatatatatatatatatatatatattaccataaaatgaatgttgggatcaaaattagtgaatttagattttgaatagataaaaattacggaatttttatttaccataatcaaaattcactaatttacgtagactaaaaatagttatttcaaatttttagggaaaatgaaaatcatatataattctttcaattacatgtaaaaggctgtaattaattaccaccgaatggatagatgatgtgatgtggtcaatcaaaaaaaagaaaaaacaattggacgaatactcaaattgattctcaaaagtagtatgagacactataattttagtccatgaaaataataacatttaaaaaaatcctaaaaatacagtttatcactcactttgatctagaattaaaaaagtcgtatgacttaagtgattatatgtattaaaataattttaagaactaaagtgaccataattaaggagttaagtttaggaatcaaaatgataatacaaaagcttattttaaattttcttactttcaaagagactaatgtggtaatgctttattcttttagaaaaaattggattaaaatatagaaatagtcccttatcttattttttattttatatcgtttccctaaattttaaaagttttataatggttatcttccatatttaatttaattatgacaagttagtcttttgataaattgatatttttttatttatttttcagcacaattttaaacctttttcttatgatttcaataagtaaaatttgtttcattagattcatttatatgaaaattataagaatgaaataatgctcgaaaaaaaggctatatatgttgtaaagatcgtatgaaaaataagtttcataaataataagaaaagaatttaacattaaatttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcattatgagattcatttttcacatatttttcatattgtttatgcatctttttgacccaaacactagttgatttttatggttttcatatagatgaatctaatgagataaatctcatatcttgaatcaataaaaaaatattcaaaattttattaaaaaattgaaaaaatcaattctttaaaggattaacttatcatgaattaaataaagagattgttttagaacttttaaacattaagagaccaatttaaaccaaaaaataagttaaggaaccatttgatatgtcatgaaaaaaataaaatcaattaactttaggtacgttgcaatatattttcttcgaaggttttttaacattctccattgtgattccccttgaagttttcttatacagtataacttcaaaattcatttttaaagcagcaacgttaataaagttgtcatttacgtatatgaattaaactatttttttaacataataccatatatggttatgcatgaatcgtgaatattataggtaaattattttttcataaacaatttctcaatcctaatcaacatgaattagtaaattattttattttatttttatgaagtccagtacggaaaatacttgcctcggtatttcatccaccatttagttttaacttttatagccccagtggaattatggaagtcctaactctgacatttgattttttatataaaaagaaaactcgagtttcttctttatcttcataaaactaaaagaaccaagttaatttttcattttttaagacaaaattgtggctcagttgtttgataggttatgatataaattcagtcacatcctcttttttcttggcaattacctcttcctcctacagactctcacatgccacattgtcaactagattgatttcatcaaccaacttgttaatttgtgtgtccaggttcccgaacacttccactccacattccacctcctttcctgtaacttaattgaagccccccaacggctaaagtttttaaagatggaaacatggcctattgtctatcttcaccctaaattgaaacctatagtaaaaaaaatgtggaatgtggttaaaattcatagtagaatacatgtacctaagtcctaatataagaaacttctttgatttagttaattactctttacaaaaggacaagagttttaaaaggaaaatgacatttgcatgcagcgctatctatcttcaccctaaattgaaacctatagtagaaaaatgtggtgaaatttctatatatgataatataattaatatatggtctctaatagagaaattagtcgtgatgacaaatggagtgaagtcaaagtgctttggcaacatgttaaatcaatgtaaatcatctggtgagaaacttaaatatctctttacctttgaaatatatatttagaaaggctaactataaaatggtattaataactagttgtagtttgaaaagttgaagaacgagacaaggaattacaattggctctcttgcttgcaacaagcttaagcatagtggtcctagaggatgttacttctaacgaaaataatggaaactgcagactaaatggtcatggaagcgcaaataagagtgatagaaagagaattaattaatttaaaaagtttattttaaaaaaaattctaaagtttatttgaaacttgatatcaagaataaataaaatcatcaaaaatagaatctcaattaattgaagaaagtttttaaaatgatatcattaaatatagtgaaagtaactaaaatttatttataattaagttcgctaaaccttttattttttttcttataattgaatctaagagagagtatgttttgaataatgaagaatttttgtaaattcttgctcaaaggttgctgcaagagaatgctaactcttaataaccagaaatataagtctccattccacgtacggtaatattatatagatagcattcaagtgtttggtataagccatgggacaacaccacggagttaagtattttttttcctcttgtattcaaataaagagcacgaatcaaagccataaacaaaatagacagtaaaatatacctttttgtcattgaataatgaggcaaagtagccacatctttagaggtatacacagataaatataataatattaaatgtctttatatataacacgatacaaatttgtcttccacttgcactagagccgctcaaacctgtttctaatgtctaatgatgatcgatctagtatgcccttcatacttataatgcacaagaggtttagtcagtgggtttgcaacattatcattgcgcgtttgttttcactttgcatattttcttatctcccatgttctctcgatcgaatgagatgtggaagtacttaagtatatgcttacatctttgatgcaatctagaatccatagttattgctattgttgcactataatagagactcataggtgattaattaattagtttttttcttaacccacatatcctggtgattagttttaaatttcttagcatcgcttagctaaataaaaaggctcctatatatagactaaaggttaggattgacttgtacgagtagctgttatgttattcatagtttattaattaggcattgttaattaggggaaattaaatatagtgcagcattgaccttgttcaattaagcttaggctttctaatttgtccgctttctgaataaatagatatggttgcaaggataatttataatgacatgataactatagagaagcaaaaacttaacaacagagaggatgatataaatgatgatgatatatagtaacaatacaagtaaaacccacgatatttgacaaactatttgtacagtacataattgatatttcagtttgctataaaaatcatcacactgtattttcaatatgacgtattattcacttattctatacttatgaaatatctctggtggtaagaaaggtcggaaaaaaagatagacttccttgctatgtatccatgcctttcataactcgagattttattgatgaaatatattagtaagtcgtagaaattctacagtgtctcattttgtgggtcgtatcttcagaatatagggcaacacctaaagcaacctctgaatggatccccaaaacaacagccgaaacggcaaaaccttgggttgaagccacgatcagggaagaagccaccaccaccaaagccaccaccaaaaccacgaccagggaagaagctgccaccaccaagtaatttggcatcaccctcattggcctcttgaacaacctttcctgcaaacacatttaactcttaacacatgaatcacttatgatagaataatgattttttgcttacccatttggtgtatgtactttgtgagggaagagagagataagagggaaagagaaagaaaatgatatattagattgacgatgagctgacaaagaaagaaaaggatataaagtgatcataaaagttgaagtaagaaaaggttaaatgataataaattgggaaaagacacagtggggaaaggggagtccattatgatagaatgaataagctaaaaaaagctcatgtattctaaacatcttttaagttgaaaggtttttgttaacgagtgcttaggacgttaatttaacttgataaacaaaaaagtcttaaatattttgttagttctgaaattaggcattttttactactttttgttattgcaactttttaaaatgatattggtaactattttctacattttgatcctttgttttttatcctataacgtatctatttcttattataatttctatattcgttggcttaatttcaattagatgatgtgaaaaatggtaaaaataaaaaaaaaatgggtacattacataaactaaaacaaaaataataaaatacaagaaccatttcaaaataaatatagggatgaaaagaaggagcaattgtaaggattaataaaatgttattgatacaaaagtattcattaattttacaaatgattagtttttactgaaaattttgtacacttttaatgaattccatcctcccaactatcttttaaggctgaaccgaagatcttgattataaaataaacttaattatactcatactaataacatggttttagcgataaaaaaatatttaagttaataaaaaatataacacatgtttataacaaaaaaaaaagcattagtaatatcttttcatacatttattatatttttaatttttaactagagttttaaaaatatttattaatattctcttatttcgaaatactcacgacagtataaggcaaaatatatatcgctcaccctcttgaaaatccctggctgtcacctctgggcagatgaaaaggaacatggccagtggaataatgagtaatgttatcttcgtcttggaacccatctttcagtagtaaactacaacaaatctactcaaataagatatatttggcaatgaaggatgagaaaattagaggaaatgtatagtctatatataggaggggaggagggaatagttgggacctttccctttattggcgccgtatagcgtactaactcaatcttttgtgaccgacttgttcttgatctgcagctcaatttccttctccattttcaatggtaaaaaattgtaggctgtgaaattgaagcactgcaattattgtacgtgactatgtatatatatatatatatatatatatatatatatatatatatttttgtacaagtgactacgtgtatatgctatgtaatgaaaagtagagaagtagacacctactgctatttaatttgatatcatgatattattttatttaccataaagaattaaaaaaacttaaagcacaaagtagattcatcacttaaatgcttttgtatcattttctaattaaaattagaattttattttttagtaacatactttattagtctttaatacaaatttttataagatggattatcaagataaaatttcaattctaattaaaataaccgaaaaaaatacattaaaaactataaattttgctctaatttaacctataggtacgtcaaatactgcaattaattacaaccgctgaatgggtacgtagaagcaaatgttgtggaaaacaaaacaagaaaacactaaagtcaattaattttaaacgttacaatttatgttgttcaaaggttgtcttttcactcctcctccattgtgattcctctttaatttttttacacagtatatactatataaccttaaaattaatttttagagcagtaactttaattttatttcatgatttatatatcgtaactttttaacaaaaaaccatggttatgaatcatgaatattataggtaaattattttttacattaaatttttcagtcttaatcaagattaaccagtaaatatttttttattaatttatataaagtccagtacgggaaatacttatgtcgggtctttcattcaccaattaattttatatttaatttgtactctcaatagaagtcatacatccgctattttgaagtttttttttttttaagaaaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttaaaaaaaaaaaaaaaagaaaaagtcaagaacacaactacacaagttttatttatcgtagaaaattgtggctgagttaccctgtttgccaaggtggcggtgctaagctcaaatgacattatatgtggttgttaattaattttcttaatggttgctaacagatttttgtctacagacttatggcccatcctccacggctttgccaacgctgtatctcttttaattaaaaaaaagtgttgttattaaagtttgttttttaggaaaaatattgaaaatatatatttctttaagaaaggatcttcaaaactaaatttcatattcgggaatatatttcctatagaaatgtgttacatctaactaaatatgcaaaattgacataactttcaatatttttttttttaccttttttaataaataataaagacaaactagtcattacaagaaaaactcgatatagcgactgaatttacgatccggaagaatccgtcgcaactagagaccgatttagccactatttttgtttcttagataaaaatatgttaacgaccgtattagagactgtattagcgaccatattagcaagtcatatatctgcgtggcccaataaatagttcaagtcacacactcccataatccattttttcttcagaggacctacatttctatctcaaaagaattaaacacattggttgctaattcattagcaaaaaatattttaaaatgtgaaaaattatctaattttatacaatatttgactacggatctaattggtggttaaagttataagaaatttaaatatatttgtgaaagcaaatatagttatgtgatattgcgcgaccaattttatcagtcgctaatgatactatcaataatatttgtgtaaagtctataaaaaatcaatttaacaaatataaaattgggaattttaacattataaatataaataataataacatgttaaataaaaaattattttactatattttataatgttataacttttttacatttttatataaaaagaaaaagaacataattgcgtcatagtgttcaccaccaagatacaaaaatgtggtgcgagagtgagaaagataaggtgatgttctcttttgttgctacttgtcatttctgtttagagtctcgatatttataaaattgttaggagtctgaattggcaagaaagttagtttcatcatgtattatgatcgtgttggaaaccctatattttggattgtgttttacatcgaatgctatcgactaccggctaggataacattctttatgttgagctcaggttaagtgttgatgtcaaagtaagggtgtttttcccctatgaagtataaggtgggttggatggttaaggaagaagagaagatgagaatgatcatgagttcaatcccctctgttgacaaaaattaatattctaacaatttaatatttgccaataaaataagtgttttttctgtttatatttatggattacttaatctgtgagtaaaaaaatatttagccctatgtattagatgttctagaattatgttagcatagatccaaaatgagtaatctaaaatgcatgttatatttcatattactcaatctagaattatgttaacataatttccaaaaagtagatccagaagtaaagtaacataattatggtgggagttttatggaacacaacatgcattctagattactcaataagaaattatgtcacatcatttatgaatcaacaattccaaaattaagataacataattttagatcaagtaatttgtaacacaacatgcattttgtattactcaaactggaattgtgttagcataattctagaattgttgatatggaaatgatgtaacataatttcaaattgagtagtccaaaatgcatgttgtattctgtaatacttaatcggattgaaaaaaattagaagaacactaaaaaaaattgctcattttaaggagtagaaatatatttaatccaaaaagttattaatagaaaataatgagttgtcaccaatgttttcttttaaaaggagcattggaaaaactctttaataaataaaaaagtcttcaaaaccaaatattagaattcatgagtcaattatttgtaagaaagatattaacatcctatatctgtcgtaaaacaattacttttagttaaatgtgtaaagttatgataatttataaatatttattttatcccttaaaaaaagcaagaaaaagcgtttaagtgttttttttatcacttagatatttttttcatcttgcaaatatgatgtttttcacttttaaatcctctaagttttgtttttcattcttttaagtttaaaatattccttgtttagaattaacaacaatctcattctgaaacaatatttatattattgataacatgacttggccatgtatgacaaaagttaaaactgtcaaaacaagtaatctgactcaacccagtttaacctattggtcctagtatgaaaagtgaatcggcctaggaaggctcctatatatagactaaaggttaatatgtacctgtttgggtaaggattgagttgtaagtcgtgtagccatgatattattcagagtttattatccatattttagttagggtttaattacgctttaggttcccttgtgctctactatctgaataaataaaaagatatggctagcctagaatagaatttgtacaatagatgatattcaccaatttatttttctcttaaactcatcacacaggctcgaagacgtgtattatacattcaacaacactattaatttctacttgcgaaatatctctagtggtatgaaagatcatggactcatgcatggatgggaatccatgcctctcaagacacaagctgttttatttcatgaaattaaaatatctatagtactaattaagtagaactgcatcgtcttaatcgtgagtcttgtcttgagtttgtgcagcaacagcttcgccagcgttatagcagcaccttctgcaacctccgttgtatgtccggccaccgcaacagccatagcgacagtagccaccaccacggccagggtagccgccaccatgaccagggtggccaccaccatgaccaggatggccaccaccgccatggccaggataaccgccaccgccatggccaggataatcaccaccattcccaggatagccaccgccatgacctgggtaaccccctccatagcctgcaccgggatatttggcatcatccactccatttacctctttaacaaccaccaaacacagttagtgaaccatttatcataataaaattatgtttgggcatgggtggaaaagttattatatggtcaatgaccactatatagtttacggtgatctcaatgcaactaattattatgtaaaactagtattttttcaatttataaaaaaaataaaattcaattatttgtaatgtaaaaattgtctcagatgactattggtgtattactttgtgtgggaagaaaatgataaatgtaattggtggcctgagggatgaaaaagaaaaaaagaaaaaggtgaacgtaaaaatttaagtgttaaataaatgaaaaatgatacaacacaccgaaaggagatttatgatccaatgaatataatttgaaacctcttgtttttgtaaacattttttaattttttataaactttttaaatttaaatattttaattattaacaaatattttagggatattaattgagaaatcaatgagtatttttttactaaaacattgcagtgaaagtactatatatagaaattacaacaaaaatatatcgtagccttcttttatatatatatatatatatatatatatatatatatatatatatattttttnnnnnnnnnnnnnnnnnnnnnnnnnnnnnnnnnatcgtagccttcttttatatatatatatatatatatatatatatatatatatatatatattctttaaccactttaaagacaattgttaattagtatcttttactttaaaagaatcataagaatataattaactagagatactattaaatgatgtatagcttaccctcttttgcattcgtggatgccacctctgaggagaccaaaaggagcatggccgaaaggcctaggatcagtaatgccatcttcaaacccatctttcagtatagaagtttataaactacaacgaatgtattcaaatgagatatgcttggtaatgaaggatgagaacattagcgggaaagtatctctatatataggaaaagaggagagagaagtagaacctttctgttaacttggtagttgctatgtattaattcaatcttatctaaagagttaataagaatcgaagagttgttcttgatctccagctcaacttccttctccattttgaatggtaaaagattgtaggctatgaaataagaagagcaattattgtacgtctatatcaacctgcaataatgtatatcaacttgctatgtactgaaaaagtgaagtaaagacgcctgctgcagcctgctagtttatatcacaattttattatatttagcataaagtataaaatattataaactgtatgtcgaacacttaatccaacccatgcatcggttaaaaagactattttttatcttaacctataattaacttcaagtttgagtaaaatataattaaaaactccgaatataatagttctaatcgactccaacatgaatggtcagtaaaaagaaaacacaacactaattacacgttgcagtacgtttgcttcagctagtgtctgttttttcacattctccggttgtaattcctcttggaaaaaaaaagcaaaaacatatattgactccctttttttttaattcctttatttctaaatagaaaagttaattctctaacttttcaaaatcaattttcagtccaattgtccaaataaatgccttgatcccatgtgacataacttaactgcaggtaatgaggtatatagccattaatctgaacgatcaaagcattaatttgaatggttaaaaaaatcactgattttgaaaattagggaacgaaaaatctttatttaaaattggagggaccaaaactgtaaattaataaaaaaaatagaaaaataaaaattatattctagaaagaaaaaaaaaaaaaatatatatatatatatatatatatatatatatatatatatatannnnnnnnnnaaaaaaaaaaaaaaaaaaaatatatatatatatatatatatatatatatatatatatatgtatgcagtacaacagtaactttaataaagtcgtgatcatttacgtgttcgatcaaattagtccaaaaagagaaccattcgaattagaatctagaatctccaataatagattgttaaccaaaattttgtatggtgaactgtaaggccatttttaatagtggttaagatgtattattggaattggtagtaagatctacctggagatttagttctttgcaaaattactaagattcatattgtttctcaaaaaaataattttcttttgtctatcgtgtacgataatttcttttttatttctatagtttctatttctactgggtagggtttcacttgaaacaataaatattttaattattaataaattgaatttccgttataaagtattttttaaattaaaaaatataattaattatttttattattttaaaataatttttaaatcaatattaaaatgtgagtttcttgtgggatctacaaaaagatttaagatcttaaaatgaaatatactattggattaaaaaatttaagagatcttaaaagtgatgtgacaatgtgaagtccaccaaaaaaatggttaaaaatctaatcctagtggaaatgtcctaagagcattttgaataaaagattttataagaagatcttaaccttaaaaaatcatcttactaaaattcattattggagcatgatattaaatttacatatagagatccaattcttgtaaaaaaaattgtcaaaatctacatctatttaaaaaaaattaattttttacttcctctttctccacaaaattgtttttcatctaatttttataaaacctaaaaaaaatggtttaagatattaaaataatctactaataaagtaaaaaatagatgagatgttgaaaatgatataacactacaaaataaaaaaaaatggtttaagatattaaaataaattgcctctgctgcgccactagaaggatttgataaagtgttggatacatgatggttcatcataataaaacttacaaaatcaaacaaatcctatctacgcctttatgtgcagccagtagttggatctagagaccatgttttctccaattgtcatatatatttaatattttaatatatttatatatatagtattaaatttagtgataattattattttaattaatatgcttttaatatataaattcatttaaaaaggtatgcatttaataaatacatattttgtttataaattttaataaatattttatatttataatataataaaatttaatcatataatacatttaataattaaattatataagaaaaacttccatatttttaagcaataataaattagttcatttgctttacgtgcaggaggtggctcactaccgacggcaaaaataataatgtatttcttttggcttatatttttaattaagtattttagataaattaatataaattaatttaaattcaattacataattaaaaatccagtttatataaaaatataaatattttattatcatatatatatatatatatatatatatatttgtttctgaattttagtaactatatcatatttataatattataaaagttaattatatattatatttaacaaataaaataattaaatttatattcaaaataattcccttatattttaaacattaacaaaaataataaatttttaatgtacattttaacacacacacacacattgatagtatgaaatgaaaaaaaatgtttaattacatatttatataaatatttatgctcaagtctacttatctttcataatttggttattttaaaatattttttataaataataatgattaaaaataaggtattttatgaataataattaaaaattggaattttttttatatatatagcacgtacgaagaggtaaagcaagtagatttgtttgattttgtaaattttattatcagcaatcagatgtatcaaacggtccgaagttgttgtagaggggctgcagaggcaatatgctagagagaatcagaacacctccttttgggggtagattagggtagatggaggagagagagaaaaaaagaagaagaaaagatagagagaatatgataaatatgatatgtgatgggaaaatgtaaagagaaatagaaagaaaaatgggttgcaagaaaatgaatgagatgaatatcattactcataaaattatgttaggatttaaacacaatccataaaactaatttattaagtgtaaaagtcataaggatgaattaaacatcacattaaataatttattttattcaatgtgagatttctaacattgtcattcttttaagaattaacattcattatgattttcactctatcaactcatcaatttagtattcacactactacacgaattgcctttaacgacaggcctcccacgtcggttattaaataaccgtcgttgttgacaatgcggtggcatttttgtaataatgtgcagtgtgcgttgataacgacgacggttattagtgaaccgccttagtattttgtgattcaaaaacggtttttaaagaaaaccgtcgttgtccttttgattaattttattttcaattaaaatctatcccagccttccttcgtaccacaccctaaaaattacactttggtttgtagtgcccccaattgaaaccctaaaaattacacttctccttcgaacgacaccggtacccgcctgtaaagcccttccgcggtgacttgacgctcgtgccgccgttaaccgtttagcatcttcaggtaatgacccaagccaatgtgttcgtgaaattccttcccccatttcttaaaaggctatttattgatgcattgagtgggctcactttgttattactagttgcaagttcttattgtccatattacgtttacgtggttttagattttgtaatatctcagaccatttggaatttgaaagttgtagatgttccaattgggagttaacatctggaagcattgcctggttgtaggtacactaagcacttggcctatgatattacatatgtgcgggatttcactgatgttgatgacaaggtagtttttatgcctaccaatgttaagaaagttgttttctaggttttgataatgttaggttacaaaaggtttgctagtgttctctcaactaacttgttaactgaagaattttagtattgttctcaacgtttagaggctggttgaagttaccaaatattccaaggttactgtttgtataaatctacaaattgttatagcttcccaagactgtccttgtagttgggatctattatttggtagtgctggctaatggctatggaatttctgttaggatttggatcatttccgtttcccgcaaaacatgacagtgtcgtgtttatgagagaaaatgacaaactactttgcgtcgaatccaaatgaccctgaattggtaatggtgggcctgacacagtaatctcgggctttctcttaaattgaaacaacactgtcatgctttttagtaataagagaggatccaaacttgatttgttgtgcatagtgcactagagtatgagaaagtttgacaacttcattagcaatttttatttttttcctctaatatattaggtatttactatttagtggttccattcttacctgttgccaggcacaatgaattgctgctgctgttttatatgggatttttatctatgatcatgagtttgcaccttagtccaacctataggtagcattttttgtaatccaactttctacaaaaatatcaatttggacttaagcatataagaagagtctaattcaaaatactagtccattaaggctttgtttgggagagggattttggaggggaaggaagggaagagaaaggtttagatggtgccttttccttgtttgggagttttaatttttgagggaaaggatttgaagatttttaaaactcctccaaaatcctccaaagcctaaaaattgttgttcccccaatttggggggtttttagaaggaaaagtaattaaaattactattctaccccaactacaaattctaaaatatattaaaatatatttttacatttaaattatataattttcatatttaatattttattaactctcaatttccctctcttaatatatttttaacttccaaacaaggataaaagaactttcctcattttcttccctttccttcccctcccttcctcttgaatctctttcctttccttcccctcctaactcacaaacaaagcctaagtgaaaaaatatctcaaaacttaaccaacgtccacaataacttttactatatcaacattgataagatagtaacccttttgcctttaaaaactttactcatttatcagtatttagtgtgcacatgaatccaaatcttttttgtaacttgaccctcaaagaaatataatggctcaagatggactgagataccatagatcattggattaaactagaactttcagaaaagcacttcctaaaagtttttgtctttccatcaatgttcctccttgaaaatggtttgtaataaccattttttatttcttttctggcgtacttaatagattttgttagcaccaaatcattacaattttttttttgtatttttactttaataattaaaattattttattaaacacaagtcatacagtccctatatctcaatgatttggatttgctcaagattgtcaagctaagaaggctcctataaagactaaaggttaatatatatacaaactttggttaggattaagttgcaagtcgtgtagctagccatgatattattcaaagcttattagccatattttaattaagggaaattaaagcggcattgacccttgttcaattaagccttaagtttctgagttctttgcttggaataaatagatatggctatatataattaagggtcatctataagtatataataactataaattaaaagaccaaacttaacaatagtggataaaataaacgatggtgatataataacgacagaaataaaaccacgatatttaagacaaattagaatttctacaatagatgatattcgtcactttaatttgctcttaaactgatcacacatgcaaaatggcgtattacacatattgaacactatttctacatgcgaaatagatctagtggtaagaaagatgacggggaatccatgcctctcgtgacaccagattttattcatgaaacatcttaagcattacgtagaactacattgtctcaattgtgagtcttatcctgagtttgtgcagcaacagcttcaccggcgtagtagcagcaccttctacaacctccattgtatgtccggccaccgcaacagccatagcgacaataccctcctccacgtcctggatagccaccaccacgaccagggtaaccaccaccgcgaccaggatagccaccaccacggccagggtagccgccaccgcggccaggatagccaccaccgccattgcctgggtaacccccaccatagcctccaccaggatatttggcatcttccactccatttgtcactttaataacaataaaaccgacttataattagtaaaccatttaccatccaacaatgatttttgtgaatgttgaaattattacatgatgtcagaccatcacgtatttaatttgggtcgcgattaatttatatgtgatacataactaacttatttaatttatgatttttttaataaaactcaattatttatgtgttaattacatgaaaattatattgtttagaatcatcataatcccggagcaagtaattatagtttttctattgaatgtatatactttatgagggaagaaaaagaaattgaagtgataagtgtaattggttgttggaagaaaaagaaatataaagatagaaaaagatataaggtgaacataaaaattgaagtgagagttttagatgataacaaaatatacactccattgaaaaaatatacaaaatacagaaagaggagtctattatgatcgaataaataggattagaaacctcttgttttgtaacatttttatttatttaaaggttacaacactaatatatattttagggacgttagctagtatagaaattaataaatgttatttttataaaacaatgcagtgaaagtactatagaaattaaaacaacatattgttgcattctataatttttgtttactctttaatgagagtgttttaaagacaataatatttgctagtattttatctttaaaatattcataaaagtacaaggcaattaaaatgatgtgtatataggttacgtaccctcttttgaattcgtggatgccacctctgaggagaccaaaaggagcatggccaacaggcctaggatcagtattgccattttcaaacccatctttcaatagtaaactagaaatgagatatgtttggtaatgaaggatgagaaaattagtgggaaatatatcctctatatataggaggagaggaaagtagggacttttctcttactaataagttggtagttggcgcgtaacgtgtatattaattcagtcttatctaaagagttaataaccgaagagttgttcttgatctccagctcaatttccttctccattttgaatggtagtaaaagattgtaggctctgaaagtgaagcagggcaattattgacatgcatcaacctgctacatactatcaacttgctatgtactgaaaagtggtgaaataattacatgcatcaacctgctatatactatcaaattgctatgtactgaaaagtggtgaaataaagacacctgctgctagtttactatcataattttattatatttaccataaagtataaaataattcttgtaaactgtatgtcaaacacttaacccaacgcatacatcagttaattaatacgagactattttatcttaacctatatattgttgaacacttacgcacattgcagtatgttttcttcaatggttgttttataatgttcttctttgtaattaattctttttggaaagaaaaaatatatcgtatagattcaaaattaacttttgtagcagtatctttaataaagttgtgatttacatgttaagcacaagtataaatagagaaatattttatatatagagagagagagagagagaatttggaatctccatcaataggggttaaatactggtaatatttttacatcaattaattataaataaaatttaatatcacagtttaattaaaaatattaagattctaatttataaatctttttatttatataatattcaatattttcatttttatccgtaaatttctttcacatgctatgctaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttttttttcaaatcctagtttaaaattattacattgaagattgaatatcataaatcattctgatatttaggttattttcattgtctaaatcttgcctttattgaaatttatgttcatgatgaagttagtttgaatttttaaaatactcatagaattaaataacttaatcatatttaatgacactacttgtaatttaaaaaatattttttttcctatatgagtgtgactaagtcaataaacacatccatttgatcatggggaataactgtaaatctctcaataatagatttcacataaataagagaacaaaaaaattagaaataaatacattttaaaaatatttttgtttcttataattagaatatatatatatatatatatatatatatatatatatatnnnnnnnnnnaaaaaactctcagttatctcaaattatcattttttttattcttatttgtatactgaatcttcttacctctttatctatttcaatctatattcttttatctttatccataaattaaatttcagtaatttaaaaatatcaataaatataaatgatcttatatcaaatttaaactattcaaaagatattaaaattatttatttatcatgataattatacacatttttaacatattatttttaacccatattttattattttatcattttctttgtttgtccattgaaaaaacatcaacttgcctacttgaattttaaaagtttaatttttttaattatattctcagcttacctaattttaaatagtgtaatttatgcacatattataaatgataaaatataatgaaagtcatattaaaaagttaaatgtcagttacattctttagtttatgtaatattttcttaagtgaataaatgaaaagaaacaaaataagtaagtatattttactaaaatttatcggaatttacaaaattaatttgtgaacctcattagaaaaataaaaggactcgcatataaattcattaattttaataaatttcagtaagtaatataaaatatacaatataaaaaaaattaagatcaaacttttgagtcaatgctaaatacaaagtaaaaatataaaagatggaataagctagtaacttttatatttaattttagtgcaataaatattttttccgcaaataaaaatataagtgtaatttttaagcattaatatttacagtaacaacatctcatcagaaataatgttaaatgtgtttttttaattatttattaagagtataaaaaaatagtaacatacagtactatatcaagaaaaacagtcgctttaaatattggatccgtggcaggaatatgtatttattttgccatgctgcccatgcagcaggttttctacgttatttagtgcgaaagacaattcaggccatcaagtcagacggtgatttagtgagtctttagatacccgtttaactcacgttgaatgaaaaaattgtgctttcaaatgcaagaacgtaaaagtaacaagatacttactttgaattcaaggaacgtttgagaccggtgaatgttaaaacaaacacactaatgatcaatggcgcaaaaaaaaaaaaaaaaaattgcatcgagtcttcctccgcactccacatacctaatctaacgtttcaaattaagtaaaatgctttaatgcattaaattcccagacgctcctgcaacacgtaccatacaagtgtacaaccaatgtgaatgtgatgaagtatgtaacctttggcttgtggctgtggctcatataatattgaatgagaaatccagtgaaccgaatctagctagatagcaactccatcaatggactcacgggatgggaaggacgaaaaagttggactccgttgctaacattacttaaatgggtaattatcataaataatgagccatgaacccactagcttaatcatcagctttcttttgatcctctcgatctactggtaaaatgtgacaagaaaataatcatgctgtagatcaataatggtgagaaccgatcactactagtacaaaaagtaaacgtttttttatattcaccaactatgcctagctatgtttggctttgcacttgtactaattattgtcatttactttcacttatttcatcatattattgttttttttttcagacttgctaatgacttgtaattttgttttatgagacttatggttactcttttttttttttttcaaatcctagtttaaaattattacattnnnnnnnnnnagtatatgagtgtatgttagcaatttttttggatatgtcaatgtacacttgtttttaaaaaagaactattttaacaagttattattttgatttcttaaaatatatttaatgtgtaacttgctaatatgtctatttgaaaaataagtgggtgattacattaacaaatctcataaataagagatgtgaataatatattaataaattacaaataattttatataaatgaagagattaattattttttaatctatgtatcataacattaaataataaaataaagggagtaattataaagctttatcagtgaaatctagtaaaaaaaaataatttaataacatagtgcttcatttcacaaaaaaaaaaaatgaagagaaaattgaaattaaattcagatacatgtcgttattctgtatcccatactcttcacacaacacacttaactttgactatatattgatgcattaaatgtaatcattattgttttagcaatttgtagtcaaattcgctatatcttgcattcccactcaaccgcataagttaaatcatccacatgactcgtcaggctttctataacaaatgtctaactaaacgataagatcactcacattcacgaacaaaatgtaaacgtgtctgctgctttgactgtgtaaaacatttattttactgagtaaatattacttgataaaaatcaacaattactaatattttaataaattacaatttgttatatatgtacatttttaattaatttatttgtgattctcaatttatataagaagaaagaatatcgggttgagtttttttaatgtgaaatagtattagatttatcataagtaattaagactgaaatacataaattagtaagtttttaaagaagccttgtaatgttttttaagtgaggttgggacacactttttagatttcaattgaaataatatgatgctaatgatggaaacctaaaatctcctaaatgttttgtgaatagaagggttgccctgcaaaaccgatactctacagtgagctaaatagaaggggaaaaattacaataaaaaatcagataaaaagaaagaaagaaaagattaaaataagataaaattataatttgtagataaaatagctaatgtaataaaaaatagaaaaaataataatgcctaaatgtataggcacaaatagtgcaaaaaattttttttacattattatccaatatttacaaaataatatataaggtaaatttgtttgctttaacaatgatcacattaatagtcatattcatacgtagcataatttcttacatgttgatagtataatatatttttttatactgacaatgttttgaaaattaaaaataaaatagtattataaaagtattatataaataatataactttaaaaaaaatcgaccaaacatctcaataataggatagcatatttattttgttcagcgaataggccgaacactaattccatattcaattagtgaaaaatgattatgtaaagtaaaatttacactgtcacttaattataattcattatatacgtaggataaatttattaacatttaaaataattattttaaagtaatttaaataataatttataattatataataatataatattattttataataataatgcatagacattaaattcattaaattaatagtgggttaaaacaaataaaataaaataaaagtaatggtggactaaaacaagacggaacgaccaaatcaaaactacttgtgggctaaaaccgagtggccgcaaccaactcgcttaacattaaaaatttctctaaattttaaaatagtatacaagaaacgatttatatatatatatatatatatatatatatatatatatataagtgtattttcctctgttataaaaaaaattaaaaaaagggacacatatttttaaggaaaaagagtgatttttatatttttttatgttttaactcctaagagaggaattggataagttaattttcaaggagtgaaaataatattctatgtgtaaatcttttattttatatttttaactccttttacatctcactttcattgaaagattttcaatttagtaatcaaatagtatatatttttaaagactcaaataacaatttgatccctatacaataccttgtttttgtattggtcctttaaagatttttttaatctttgtaaatttataactttttattttagtctatgttgttaaataacaactttgaaatgatgattaatgatattaagagttcattaacttgtcacaatcattaagagagtatttgtttcaaagtttaatattacattctcaggaattatattccttgaaatactatgctgaatataatattcacataaattttttggttggtatttgataatttcataaaactatttaattataaaaaaaaaaaagaagaaatggaaaaaaaatatagcagaatggatagttaacttctatttccatggaaatatatatactcgattatccttcattatggaaataagaggtgagacacatatgagtatatcatattcctacaatcaacaatgtctggaaatataattttaaaaatttttaacaaacatggaaatgtgatatcatgtgttcacattttttagattaatttgtaatatcttgaaacaaatacaactagtctgattggataattacattttttttaaaaactatttttattctttttatatatcaccaactattttcagcatataatttaaaaatatagttatatatgtgtgtgtgagattgatctatcagattttttttataacatatcaagacaacaaatttggtcacgttattgttacatgataagttaatgttattacagagtttgatattacaaacaacgttcttgaaagttgacatttttaaattttcattaaatattgtaggcatgttagttgtttccttccttccacgctctctcttttttttttttttcatgaaacattgtttcctccataaatattacgccttattttgtattcttttatatttgattaacaagtatgattttattttgcaagaacaaagcatgttggagatgctaattcgttggaagtggctgagatgatatcgaccggctcttcgaacaattaggatgaacccccaacttaatagtcaattgttgttgtctgcttataatgctcaagtcaatatgagtgtttgcagaatttcaatagtagagtttaaaatacttatcaattgtttggatggtaggggtgaacaagagacaggtggggtcgggttaaattcaattttaaccttctgtttctaaattttgatcggatttagatcctaatccatttctagacttaaatgaacctaatgatctatgatttaaattaggataggatctatttaagacaagatcaagttgactcgaaacataagaatgtaagttttcattttctattaatgtaattgagatttcaagaataaactttatcttatttttatacacgatattatataaattaaattatagttacttgtaaccataaaaaatagttttgacatcaatttggaaaatatagacaaaaggagttaatatgttagtgttttttcagtgattaacacaacaaatgaaatgcactgtaaagatataataaggactattaaatttaagatctggcaaagaaaaaattgggatagcttgtgtttaaccctaacctatccctaatttctgaccaagtcaatattctaaatcctaacttgtctctaagcctaaatgaatctaatgatttaacgggttaaattaggatggattggaggatcttgcaacccccccccccctattgagtagaatatttatacaaaaaaagagggtggcgtgggtggataacgtaagtggaagaatgatgagacgttttatcagtctattagttattttcacacaatttatgagttgagaggagttagagttatcccataccaacataaaatccactcttagcaatgtatgattttagacatctatagtacacgtcaacaattaacgtgagttccatgaaatgtatctcagttaccaaggtggaaaaattcaacatatcatttgtggattttgctggaatattaggtccttaattgcttgacctaatacaattttgccaactgttagaaaattgatcactaggctatagctataaacttgtgtggagcaaacaatgaaggaaactaactgagtaatcaaattaacaggtaaaaatcaaaattctactcatcaacgatttctaaccaaatctttagtcatccacaaaaaattcaacctcccaaaccaccgacaaagcgcgatcaacatcataataattagttaatcacccagcacgttcctatgtgcagtattattacaacaaataaatgacaattataatcacaggaatgaaaccagttttcataaatagacgtttgttcctgctaaccacatgatgcaaattaattaaaatgaacaaggtacctagactatatatatatatcgtctaaattctctcaaacaggacgagtcggggaagcatcgttaaacgggttaaatatgaggttttttgactgagggggcaattttttttttttaattaccatatggaggcaaaaatttataaaattatcatttgggggataagtgtatcacgtgtcataacttctaaattagaaatcgtgttatgtgtcatgacctagcctttgttgttttttatttttcatttgaagtcgagccaaatttacgattttattgtgacttcaatatatttgctattcaaaagtcataaatgaatttacaattttaaagtcgtaatacataatttaatttttatttttgaattttaaacagaaaatactttaaaaaattgtaatatatttacgactttaaaattatagcagctacaactttttattcattttttattcatttgtagtagtatttacgactttattcattttttattaatttaaagttgtaaatactcttacaaaattaaattaccattattgtgtcaaatacttaattaatataattatatttgtaaaaattacttaacaagaacaaattaaatataacttatttcatatattaaaagcaaatattattatcaaaatatattaagtatttttaaattttaaaaattacaaacatattatacaaaaataattaaataaatattcataatacaaagtaattnnnnnnnnnnacgtaacccttatatataacaataatttaaaaaataataaacaaaaattaacaaaagaaaactaaataaaaaaccaaaactaataataaaaaaaaacctaaaacccttaaatcaatggattacgtaacgcatatatataacaataatttaaaaaaataataaacaaaaattaacaaaacaaaactaaataaaaaaagtcggatatatattaacgactttaaattcgtaaatataatcacaactttcaaactaacttaaataatttataaaaataatttaaatactttaaaaaataataaaactaaataaaaaaattaaaaaacacgtacaatcataaacatttttacgacttttgaattggcatttaaaaaaattatttttttacaaaatcaaaaatacacaataaaattataaaattgactatgactaaaaaaaaaagtaaaggtcatgacacatgacacgacttctgatttagaagtcgtgtcacgttgcatgacttacccaaatgataattttataaatttttgtcccatgtggtaattaaaaaaaaaaaattacccctatgtcaaaaaacctaaatatgattgaaacttggtgttgagagagggaaatggaggggggaaaaagtaaattacttgaccagaaatatcattttaataatgttcagcgggagtttaagtgttaaattttaaagacttagttataaaattttaatcttataataatttaattaaaaatttaaatcatagaaaacataattaaaaatttaattaatgaaattaaaagaatatatcaatttaagtaattataaatatattattttttaattaatttaataaatgactatttctcaatttattatctatttatattataaatctaatatatggctatacaaatgttatttttcttaacttttaatttcaataaatgttatatcttctaatactttcaccaaatcttcttcctggtctctctttactctttcaaaattcaaaataagaatgtgttttaaaaatcaatccaattaataacctaaataatcttattatattattaggtaaaaaaatgttcattttcatcacaatgttaatattttaattggttgatttgtaatatgagaaatattgatattacattctctaacagtaaatttagtaggaaagaaagaaatatgttaaaactatgatggattgaaataagaaagagagaaatagagtaaatgaaaatagatgaaaaatagagtaaaaacataagtgtttgatttaaggaaaataagaaagaaataaaaaagagaaaaattaaaaaattcattgataaacaactttttaacaaataattgattattttatatgactgctgctttttgaaaaataattttatgcgtttttggtagttttttaccaccaatacatttctatcactaaatgtattttcctagtaattttcaactattgttaaaaaattatcacaaaatgttaaacattgacatttttactatttaattctgttcatttttgtgaagaaataaaaagatgcatgtgagactcgcacttttttttttatttctctcactagttatttatcctctaataaacatactctattttttattttcctctatttcaactcctcctccttatttcttcttcatagcatccctaccaaatatatcttaacttttaaatattttattattactgattgaaatttattagaaataaacaaaaattatgctcttattattttacgtgtctaacttgtgattttctagtttctaaaagttttaactaatatataaacgagtgtgttgacgagaagggttaaaatataaaataaagagtgtgaaagttgataaagtgaaaatagattgagaaaggacatattagtaatctggtcatcatttattatttagcaatttgttcttgagaaatatttttttagttacaacaatgcttaacttattaacagtttatggttttgagttaacttagtggtttcggcccagcatctcaacgaaaataacacaaacataactggataagactaatgggtctctcgatgggttcacaaggaaagagacaaaaagcccaaaaacaatggaaagcatgaaacaagactgacgcaataaaaagacaacaacaaattatacttcctgttcttattttcatcttacatcaaactctcctaattttgtatcatttattatactgtgactccctaatccccaaacacgataaaaaatattaacagaagctaaacatgtgatcttcacatgctttttaatgattcacttaaaatgaccttatctttttcctttaacaaaaccattttgatttattttgtagatgttgatacactaataaaaataaatttgcagatctagattacacttgttcaaacttcatttggggttcttaaaagtaacatatttgttttaaagatctgtactacactcaaattttgtggtgatcaaggataaatatagccgttgctattaattgtgatgaagggaaattgttaacgtgcatttcgaaatgggatggattgggattgaaagaaaaatttgaaagagaagaagaaaaataaagataaagtaataaatataataaacaatgtaataagaaatgtaaagagagattaaaaaaaatatatgttgaaacaagaagcaaaaataagtacatatttataattatacttttttaaaaccaaccaaatatttgttgatctaccggtgagtcaccccttttatgtaaacttatagaataatgtatttaattatttattttagttgattaatttcatttattgttaatttagtgtttttagagttgatctcaaacccaaatcaaacaaaaagggaaattaatttctgagctttatgttattagtcctataaaattcctcaaaaaatagtccttttattttatataaaaaagcctgggcctataaaataacagtaaaaataaaattaaacgaaataacataaaaatatcgaacaaaactaattgttgacacttggataacgtaaaagatagattttaataagtccgacattttttttaaactagaaggtatctggacttctattttttattgatgaaagaagcatgggaacaactaatagttgagatcgccagatgctaccctttttttttaattacttccattattgtattttcagaaaaagcataaattgaactctatgaacagaaaccaaaaacaatgtagcgcggcaagcattaaagctgaatttcgtccaatagattttagccatgatgcagcatgaatttttgtccctaagcaacaaaatatgaataaactaaagcatatcctttgcttaatctttgagcattaaggcaccgaaagtggagaggaaaaatacccttaattagagttattattatttagagtgaaacagaaatgagtgaaataatcggtgggtacccttgttttagagtgcggcatatcgtttttgtgcccctaggtccacaaattaaactcgtttcgttccgcgtttcacccttgaatttgcccaagactaagggacctttttgataattagaatgaagacttcccacaaagttcaacttcaaatatgcgttggccaaccgtttttgacgaagcccactgactcaaaaatcagaatttaacctcgccttcaatagtcctaattctcccaacaaacaaataatctttgtgatcatttgactgtttaagcaacacagtgcctattacatgacaatttctctgattgattaatgcttttagtgcatatagtactatatatagtactattttcttttaatattatatccatgcaactgtaatgttatttatattcaaggaaggaggatcttgaaccatagacataaacacaactaattaaatacttgtatttgaccccagttgatcttagacgtctcttgtaacactattacaaaaaaagaccttttaaagatggtttttttaaatattgttcatcataatttttaaaccgtatcaaaatgttgatttctacatctatttttttttagaaatagtctaaaaatgtgttattttttattttaaaaatgtaagaatttaaagacgatttttatgcatatatgtcttaatattgtgcatgatagaatttcactatgtcatcgtgtattataaaacgtgttattttaaaaaaaaaaatcgtcttaaaatgtatcttttctaatacaattttttttagaaatcatttaaaatgtatcttttctaagacgattttctagaaatatatagttgtttatttttttaaatgtgtatttttttttttttacatcaaacccatgcttttatgtttgttttactggaaaaattcaccattctacgttcaagcccatgcttttatgttttgtggtactggaaaaattcaccattctacgttcagggcttaaaaaaaatgtgacctctacctcccacacaattctctttatatcagatatgtatattctttatctttaagttacttaccctccacacttgcgtctgttctaaattctaattacaattaagctaagtcctcaattgggcctaaaggtgtaaagttgttgggctttctagggcccaagctgaatcttcttatgttctggtaataccaggaattaagctaaaactgattaggcaaccctcaacaagtcaacctttctattttcatattaccaattccacataaaactaagtaaaataaaaaagaagtattttcttcacaagttacaggaaaaccagaaaacctagtaaaatgaacaatttattggcataaattataaagaagataaataagattaacttttgaaagctgaattgcaggcatgcaataatagaacagtctgaacagatcacaccataaggttgtatctaacaaacagcaaggacaaaagactcaaaattgaaatggcagaaaatgaattatattgataagcacattcacaaactatttgctaaactctacctccacacaattcttttttttttgtaagattattttctaatttttaagtgtattaattaatttttcttagatacttttatttaattattttctctcgaaacattaatgaaaataattaaataaatagatagatagataaaaaataattttaaaataataatacaaataatttacatatttaatgtaattaattaaattttaattatttttataaatgataataaattaattgaaaaagtcttataattaataattctagaacaaacattttcctactggcatgtgtgccaaataaaagaacacattattcaactttataaagacctcataaatatataccagcaggccaataaaccaacatggggaagcaaatggaaagcgtgtgacataaaacgtggtcggcaagcattcgaattcaaaatccacgactgaaaagcaaattaaacaacggtcacaaagaaattaaaccacttctcgctcataaaataacaaaccgctaccattgctatataaacctcaatcaaccaacacaagtctcataccaaaccaatattcatcaaccaaaacacatcaaattccactcactactactctctctttccattattgtccccttaaaaattactctctttctctgtccttaattataagatcgttttcagaaaacatgagtgtagaaatactagacggtgcaaccatcctagggttcgtggaggacgaggaagccttcaacgtgtgcgtgagcgacctcttcacccaactggacaccgacaacgacggtgttctctcttacgcggagatgctgaaggagttgcagaggctgagggtgttcgagatccacttcggcgtcgacgtgaagcgtgaccccgacgaactcgcacgtgtgtacgagtccatgttcgtgcaattcgaccacgacttgaatgggagggttgaccttcaagaattcaaggaggaaacgaagcagataatgcttgccatggcgaatggacttggatctctccctgttcagatggctcttgaacacgatagcctcctcatgaaagctgttcaaagagagtactgtcccaaaattgccgcttaaagaattaatatgcatatggggaaattttgcatccaccgcgcgcaatatatgcatgcatgcatggtggtgatatatatgattcgtcatttataagctttcttacgttttaattttgtgtcattaattcagtggtttatatgtttgtgttttgattaacttttattgtagttgttggctagttgggtacttgcgcttgttgattgcttaactggtcattgatcaattagaaatgagaaattaaaaatcgtatggaataatttttgctgcttctttttgtttttgtgtcagagtttaaaccatgttgcccacgttcaaccatgctcatgtacgtatgcgagaattaaacagaggagtttaattaattatctatcttctatcgtgtcttctatcagttaaaaattacttctgaagtgaagatgaagatattagattgattcaaatgattagaaaaaaatgatactagaagggaggaaagaaaaaccgtgacttccaattcctccaactaagatttctaaagtcaacctatcattttctcttttgtctttcaactcacaccgcaccaccctctttttttttattaagcaccgcacccccatattctaaaaaaaaataaaaataaaaaaataaacacgaatgcacgagaattaaacagaaaaggaacgtaattatatgtcttctatcaattgagagtcacttctcaagcagcgaatctatcattttcttttgtctttcaacccacaccgcaccaccatcttctataaaaacattaaattttagacagaaaaggatttttttttttttctataactaatgttagtggttagtttattagtttatgttagtgggagaaattcaaacttataacctctttatctctccttttctctttaaacaataaattgacctaataactccaacatcaaggaaatttcatgttttttttaaataaataaatatataagatcttatccaacacttacgattgatttttaagctatatatttggctcaattattttagtgtaaaagtaaataaaagttaaaataaaaaataagagctttaaaaataaaataaatagttcaatcatttttattttcttttaacttaaaggaaatatttcgtcttgtccatattataagatatagttttagaagaaattgatggtcctttttataagaaattttagaatttttatgaagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaaagaggagataaaaaaaaaagagataagagaggaagaagggaaataaagagtttagagagccacaagataaagtaagaagacattattagaaaataaatagataaagactaaaatatattttttatctatgtaaattagtattttttttgtttgtttttttatccctataagttatttttaattttaatctttataagtttatgttttttcaatttaatttttgtaaaatattttgtttatttttatatcttgtatgtttgcttttctaaaattttggcccctgtaaacatgaacttattaaaactataaataaaaaaaataagaatcttacaaagatcaaaattgaaaaaaacacaaatttacattaattaaaattgagcaaaatatctcatagaaaacaaaattgaaataacaccaatttattgagactaaaattaaaaaaaaaatgaatttacatagagcaaaaataaaaataaaagtattcaaatttacatatactaaaaacatatttaaaacataaataaataaccaaagagataagaaaataaattaacaaggtattcttctaaggatggatcttcacctacctcttttattgcaaggtttatcgtcctttcatctccaactaaaactaaaaccgttgattacattatttctggattttgggtacatttttttttggtggaagagaggggattttggttacattgtaacttggttaaagaggatctaaatttcttcttctttttcactaaagttgcttcactcaatttgtttttcatcaactaaatttgtttaaaattttactttttcttatcatttttatattatttgagagttttaaaaaatatgtttcaccaaattctttctaacaataaaaaataaattacactaacaccacctcagctaattattctaattaaatatgcattatattacactggtacctcatgatcctttaacaccgtcaattttgttaactccaacagatcaagatcaagtgccagcacatgtattttaatgatttttttttttttgtgcttaaatacccctctcttctttttgggtatctgagtttgaagaaaaaaataattgcagcaaagagcaacttcaaatcgaggaagaactccaaacaccatccaaaaaatttactttgaatctcatattaggagttctttactttgtgattttttttaataatagttagaagtaacgtgttaatatcatgaataaaaaatgtttcaacctgttggaaaacttgcatcagcataaatttctttcacgaaaattagtcaaataaaaacaaaagaacccatttgagtatgttgaatttaacgtatctcaaaaaccaactaaattgtaattgttgagatctccctgtgaatattttagtggaccgctaaaactaatgtctcgatgaaacaaagatcaagaaaatcatcatcaagcactagcagtgagtaataaagatcgacgatggaatcaaatattcggatcggagcaaagcttttgagaagatcgaattggtgattgatgttgcatcggagtttggacatcgtgaatcactaactgttggacagtggaagcggcaataataccctgcagagcttgaacgcaatgacaaccaagaatggcagttttggattttcggaaaggttattctcgtaaatgccttgaaagttaacgttggattaacaccatcagacagaaggagtgtcaaaataatgccttcaaatagaggaaatatatgtgtaattaaatcaaatcttagacaatgtcagtgtaatatactaaaaacaatcctaccaaaagttaaaacaaacctagcctttaattatgtaacaaaaaaaaaactagccttacataacaaacatcattgtcttctacccattttttttttataattaagaacattccatttaactactactaggaattgctgttctctgcaaaaagattcagacatattttaatgagagtcaatcagtccacgcgtgttcttcggtttcacctttctactttccagtcaaccaagcacaatatttaacgctaacgtcaacctaattccccatcgcaagtgcaaaatggaagaaggatttcaaactgaaaatatagaaatcaactagtttccatggcatggtgcggataacatctactttgagtcaacaaaaataatacaaaaaaaaaaaaattatgtatggtcagtgtaaagatgtttacactgtcaatttataaataattatattaaatatcttttaaaaataattattataaaaataattaataaaattattatacattattaatttggacttgtacttaaaacattattaaattaattcttatatatatatatatatatatatatatacaattgttatatgtttagttcctatcatcttctcagaatggtcttaggttgagttttgtcattgaccttgagttatttttccctctccaaccctaaataacttacatttcacttcaaataaaattgtgcaatccaaatcaaaccaaatctacaaaaatcagaccatctaaaatgatttttataacccaacctatttattatttgaatttggatttggtgagtcatttattttaatcggttttgcaacatcacattccaagcaccattgtgaacaaaactccttcattccctcaatcttgcccaaacacgtaaaccaaacatgtgtctccctctcttactacacaaatacataagaagagatcatcaagtgattttaagagtaactctaaattcttgtcctttatttttttataatctaatgattttagtaaataactcacttttaatcgtaagattagattataaaaaaatcaaatgaaggacaagtataagaaacacaatgtcattatttttggttaagaaggcatgaacaataacgacagcaaattttaggggtatgaatagtacgaataagataacattgtttggccgacgataaaaaaatgtcttctccttttgttacctgttatcggtctcgttgtctaatcattgttatttcatgttttttcatctcaaacatcgacagtggtccaaattcaacacctactgtcactaccattgtcttcaacaactcctctgatataaagcagtagcatatagagcaaattgaggagaagaagagaccactaaatgatttgtgcatctattttagtaggcttgtgttgtggtaactcggcaccacacaccttctcggttgggagtaactcctccaccaaccacaaacacagggagtcaccggactcaacccacaatcaatcaaatagtaataaagtgcggaaacgtgaatcaaatcaatgaaggatgcgcaagagatataagggagagaaaaataacacagatagctttacgtgggacaaaacctccaagaggaaaacccatggaacctagtccagaaaataatccactattctcaataataatggttacaatcactcaacagtctcacgccggagtcactcacagtggtggacactcactctcaacaagagttgctctcaacctctcggagacactctcaacggccacaatgccggagacactcttcctcaccactgtttcactgcactctcttgcaggtctgcgtctggtacactagccagcccctggtcctcagtccttggtcgcaattctccatctataaatgcagtatttatagagagaattaggtttaggatttctgcaccctaaacggggaattgggccgaggtcaaccctcgagatttgggcccaagtcaacattccctttttttcaactcctagggatttgggccaagcattaaatggaacattatccaacaaatctcccccttccgtttcaatgcgacacatcagcaacccggaaacctttccggtcttccactaaggtctggagtcttcaaacaacacaacccggccttctcatctcggctttatcatgccgagttcatcagcctggttccttcacagcaatcttcaaattttattgttggcaccgactttgtcatcatgtcagaccaattctgacttgtgtgcacctttccaagtgtgagcttcccatcctctaccgcatctcgtatccagtgatacctcacatcaatgtgtttggtgcgagagtgatacgccgagttccttgcaagatgaattgcactctggctatcgcacttaagctcatacacatcttggtcatggtcgagctcctggagaaacttcttcatccacagcaactcttagcacgcttctgttacggcaatatactcggcctccgtggttggcagtgccacacacttctgcagtctcgactgccacgagattgcccctccagcaaacgtcatcaggaatcccgtcgtcgactttctcgagtcggaatctccccctaaatcagcatccgagtagccttccaactcggccttgccatctccaaaacgaagacacacttcggttgtacctcggaggtatctgaagatccactccactgcttcccaatgctcacggccgggattcttaagataccgagtcaccactccaactgcatacgccaggtcgggtctagtgcaaaccattgcatacattagactctcaactgcagattggtatgggatcttctccatctcctctctgtcttcatctgatctcgaacattgcctctcactcagcttcaaatgtccggccaagggggtgcttacttggctttgtccatgttgaatctcttcaagatcttctcaacatatttttcttgacttagccacagtagcttcttcttcctatcccggatgattttcatcccaaggatctgctttgctggaccgaggtccttcatcgcgaaggatgagttcaacgccttctttaagacggcaatcttcaccttgtcttgccctgctatcagcatatcatccacatatagcagcaagatcaagaaatcaccagtctcatacctctttatgaaaacacagtggtcggcttccgtcttcatgaatccatgctctgtcatgaaggaatcaaacttcctgtaccactgccgaggtgcttgcttcaagccatagagactcttcttcagtcagcacacttttccttcacatcccggagcctcgaacccttcaggttgctccatgaagatttcttcttccagctcaccgtgaagaaatgccgtcttcacgtccatttgctctacctccagatccattgttgctgccatagctaacattgtccggatcgaggtcatcttcacaataggagagaaaatctcatcaaagtcaatcctcttcttctgattgcagcctttcactacaatctgggctttgtatctcggcttcttgtcgttctcctcctggttgatcttatacacccacttgttcttcagagctcgcctccctttaggtagctcggtcagctcatatgtctgattatcatgcaaggatctcatctcatcctgcatggccttctcctattcatcactctctggactctccaccgcttcatcataactttgaggttcaccatcctcagcaattatggcatattcatctggtgggtaccttgcagaaggtcttctttctctagtggggtatctcggctgttcttcctcagcctcctcagaatctgattcttcatcttcatcccggatcccggcatcatcatcatcttcatcgcctccagcgatttcttcactggtttctccccctgcttcagcagtctcacgagggacaggttcttcacttcggacagtaacccggacttggatcttcgagatgtcatgaatggtttcatcctcatgaaacactacatctcggcttctcacaatcttcttgttgattggatcccacagtctgaaaccaaactcgattttcggcgaaccgaggtatatgcactccttcgtcttcgcatctagcttcgccctcccatcattagggacatgcacgaaggcccggcatccgaacactctcaagtgatcataggtcgctctccacctgtccagacttcttctggaatctctccatccagcggccgtgatggtgagagatttatcaaatcaaccgctgttctgactgcctctccccagtatgctttcaacaagtcggcattggatagcatacatcggaccttctcctcaatggtcctgttcatcctctcagcgagtccattcagctgaggtgtcttgggggcgtcctctcaaatctgatcccgacttctctacagtaagcctcaaagggaccacgatactcaccaccattatctgatctgaccaccttcaacctcttgccagtctccctttccaccattgcgtggaattccttaaacgattggagaacctggtccttggtcttcaacgggtaaacccacactttgcaggagcggtcatcaatgaaagagacaaaatactgcccttcgccaatcgatctctccgacatggagcaaacgtcaatgtggacgaggtcaagtatgcacctccgtctcctgggctgatccgatctcacaaacgaaactcggtgctgctttccagctaggcagtgcgagcaactctccagcacttgacccttcaacccggtcaatagctctttcttctccaagatctcaagccttctctcactcatgtggccgagacgcttgtgccacaactccaggcttgatccatcaaaaacaatgttggcatcaccgccaatcatccttccttgcatcacatacaaggagccttccttctttccacgggctatcaccaagcttcccttggatagcttccatctacagccctcaaagtcgttcactaacccggcatcatctagctttcccaccgagattagattcaaccgcatgtcaggtatatacctcacatctttcaacacaattcggcaccctactttcgaggccagggtcacatcgccgacatcaacaatcttgttggtcaccttatttcccatcttcacagctccaaactctccactcgtatacgaagagaaaaaccttttgtgaggggtcacgtggaaagaggcacccgaatcaactatccaggcacaatcatcaaaggaaacattcacaaaactctctctgagaagaaatatctcggcgccaacactagctaccacagccgtggtgctcttcacctctttcttaccctggtctgacttcacagacccactctgctcatctctctgaagagtccaatagtctgttttcttgtgttcgggctttccgcagtaaaagcacttcagttcactcttcggtcttgaccggtctcgggacctatccggtctctcacgacctcggttcttcccacgaacccggaagtcggacttactcttctcagcaacgatggcatcacacgtgctattcatacctcgttctctcctcctggcttcctcattcaggaggctgtcagttacgacatccatctccagtttcccttcaggagtcgaattactcaatgtcaccaccagagtattccaactctctggtaatgaacttagcaacaacagagcctgcatctcgttgtcaatcttcatgtcggccttggacaactggttcacaatacctttgtatgtgttgaggtgttcaatcatgctcatcccgtccttgtactccagcttcacaagccgacgaacgagatgtgccttgttccttggagttttcttctgaatcatggactccaacttgttccataactcgtacgcattagtgaactcggacacatgctcaaagaggctcttgtcaatatacttcctgatcgtggccactgccttccgactcaggatctcccactgcttgtcggtctttccagtcggtctctcatcaagcacaatgggctcgtacaaatccttgcagtacagatgatctttcatcatcggcctccagtaggtaaagttgtctgcggtcaacttgaatatatccccatcatggattatgctaccactgttctccatctcggtatctctctctcagaacccttcacactgggctctgataccactctgttgtggtaactcgacaccacacaccttcttggctgggagtaactcctccaccaaccacaagcatagggagtcaccggactcaacccacaattaatcaaacagtaataaagcgcggaaacgtgaatcaaaacaacgaaggatgcgcgagagatataagggagagaaaaacaacacagatagctttacgtgggacaaaacctctaagaggaaaacccacgggacctagtccagaaaataatccattattctcaacaataatggttacaatcactcaacagcctcacgccggagtcactcacagtggtggacattcactctcaacaagagttgctttcaacctctcaaagacactctcaacgaccacaatgccagagacactcttcctcaccactgtttcactctgcactctcttgcaggtctgcgtttggtacactagccagcccctggtcctcagtccttggtcgccattctccatctataaatgcagtatttatagagaaaattaggtttaggatttctgcaccctaaacggggaattgggccgaggtcaaccttcaagatttgggcccaagtcaacattcccttttttttcaactcctagggatttgggccaaacattaaacggaacattatccaacagcttggattgacaaggacgagatccagctcttgtgagggttcctcgactacacctcatagcaaggattctttcaccacaatgccactgttttattatacaaccaatcaattattgaagcgccaactccatttcaataacaactagctagcttgaaaatgttgatatttgttgaacccctaatgcataaaaagatttatgaagttttgatgataacaaacaatcaatgtcacattattagatttattgcactgatgataattatttgatattttgatcttactgatattttggatttgatattttgaagttattgatattttggatttatgaagatcaacataattgataaaattatttgaaaaatcctaaagattgatatcattcaagatgacatgaaattaagaaaatttgtctctatttatttttgagattttatgtaaggagattagaagattgatcttgtcaatatatttatttttaagattgcatccaaaaataggatagaatatttttaatattacatttaaaaataagatataatatttttaagattgcattgcataatataatagaatatctttaagattgcataatatcttttaggattgcattcaaaaattagttaaaatcatatatttaaattagtataaatagaaacatatgttactatttagagtatgcgttcaattccaaataatattagagttttagagagtttatgtttgcatcattgagagagttgttgtgagatcatatagaaatgtttgacaagtttgattattcaactctccatcaggatttaaaggtacctatttgcttaaggaataaaagcataaacgtaaccattttattgtattcttcttcttgactttgaaagaggtcgcaactgagaaattaggataccagttctatctctattcttggtgaattgagacgtgtgacttttgactgggaaactaggatactagtctagctgggaaacaatgataccagtctgtctttattattgatgaattgagatgagaactttttgctggaaaagaaggataccagttgggataattgttgtgtaagggtagactagaaaactaggatactaggaactcttgtacacaaaattatcatagtaaagttgtccattggattgattatccaatttggacgtcgtgattttttacccaattgggttttccacgttaaaattgattgtgtcttctttgtctcttatatacatattattgctttgagttttattttaaaatgtgaattattttttaaaattcaattcacacctgcccctcttgagttcatctaggaccaacaattgtatcagagctgtgttctctttattttgcaggtaactcttgaagagtagatcttaagatgatcccaatggagacaataagataaggctactttatccaaaggcctccactattcgaggaaaagtactacaattactggaagaacaaaatggagatttttattcaagcagagaactaactggaaggtaattgaaaaaggagaatttcagaacacaaagatgaatgaaaagagagaaagagtgtcaaaacttgaggacgaatatactgatgaagattggaagaagttggaatacaatgctcaagccaagagaattcttcactttggactagggacacaagaatacaaccgcgtgatggatttcaagactgccaagcaaatgtggaatcttctagaggtaacacatgagggtacaaacgaggtaaaacagtctaaaattgatctccttatacatcaatatgaactgttctttatgaagcctaaagagtctattagggatatgataactcgttttactaacatagtaaatgagttaaatgttttaggcagggacatacaggttgaggagcaagtaagaaaaattctgaggagtctccctagagaggattggatgccaaaggtcactgctttgcaagaaaccaaaggttttaagactttcaaccttgagcagttggcaggatctctaatgacatatgagatgcaactagagtcccacagaaagaaagatgtaagattgaaggataaagacattgctttaaaacctcaatcaaaggaagtgagtgatgactcaaatgatgaggaggatattgaaatgcttgggcgaaagttcaaaaaacacttaaagaaccaaaagtttaatggaagctcaagcaataaacaggtaaaatccaaaaccttctcttattcaagaacttattatagttgttttaggtgtggcaaaacagatgatatgtgcccagcatatggtcctttccaagctattaaaagccaaaaatcatcgacaaatagcttagaattgcatatgattatgataaatgttgatgaatccattcctgtcatgtgttgtgctaatttgaacatctttatagcaggaaggaacatgattcaagcattttttggaagcagatgaacccacgccaccagcgtggaagtccacgccatcagcgtgggatgctatctctatttgcaaattcctctggagtgccacgctatcagcgtgggagtctgctgatggtgctattgagggcagatttggactttcacttaccctcacataaatacttgaacccagagctttgaagggggactggagagcacaaaaatcacttggaaaaggaagagaaagaaggcttgggagctgagctagggtttgggtgtgaggggaagaggtttcttccttcttcccttcctcttcttccttgtatatcagcagcatgcttctttttgttgtaccaaggccatccatgactaggtttggctagtttcttttgtagttaggacaaatactcaatgtaactttcatttggattgggttgaatgttattgttcattaatgccatgttatttcattacactttgcttgaatatcttcatctcttttttagatctgatcaatctatttaagagcttagagctagggttcacaataaggatattggggctttagtcttggaactaagtgtggtgacttgctttacatcacctagggatagggatgtatgcttgcaatcctttctagtgcatcatttaatgcttaacctaataaatgctactaagggattagggtgttgaaaagggttaaagggttaatgtcactaagggattagggcttaactattattgaatgaagatgtatgaattgagtaactggtatagatgaatgtagtaaacaatccatgtaagaatgtcaggagcattgagtgtgggtttccctagctacattaccttacgtttggtacaaccattatctattttgtttataatactttatgttcataattagcttttaattcacttcgtacacacaccacatccatttctctcaaatattgtttttgtcatccaacctattgatacgatttatgatttaattggtcaaacaatcctcgtgggacgatatcttttcttatcactttattacttgagcgaccggtacacttgccgagtgcgcaacaacagatcataggattaaggattgttctgaagtagagcaagaaagtagaaaggagaagaaggctaaagagcataagaagtatgaaaagaaggagttcaagaaagcaatgatggctgcttggagtgattctgattcagaggaagaagtctttgaaagcagtgaagctgagactaacatttgtcttatggctggaactgactcaaaaggtgaagacactcaggtaaattttctttgagttgagatcttccatgcatttgttaacaaagaggcatctattgaaaatgtcagactttgtaatagatgagtatttacaaatacgtgaacataatgatgagttgattgatgactttgttgaattaaagaatgaacttaaaaaattctctaaggctaataaagaattgagaaaaaccaacgagagcctagaggaggaaatcactagccttaaaaatattgcttttgaacttgaaaacgaaaatgcttctctgattgttgaattgaaaaagcataagaaagaggaatgtgcggcaatttgtgatgctctattggaagaaaaaattgaaaaattggagggtgagatagaaaagttgactaaagagaataaggacctccaaaataagctaaagtctgcccttaggactcccaagatagatagacccaatgctatttactggttgaataagaattgtaacacatctaggcataggttaggctttaaagagaataagaaatctacctggaaaacaaaaactaagcatatgaacttgtatgagaaaagtgtgtgttatcattgtgacaaggtaaaacatcttaaatttaaatgcaagaataggataaaaactattgaaaagaatgtcacatgtgttatataaataaaattctaaagttttaattttttaatcaattatgtgattaatttcatccctcttcaaaaatatattatatataaataattaaaatccaattttttttaaaatttaatatatgttatcaattgagttctattatatatatatatatatatattatatattgatatttgttgatattatgggaaatgggaagagaagactctcgagacgcgtttaataatgcatataggaatgcgacaaattagactaacattcaagttgtaactatcagttattatgtattgaaaataactttttttgttgttgtacatattacatgtatccgtctgaggccttcttgcagtaggtagtaaaattatctctcagtatcaacagtatatatatttaattctatcatctatctctttctctgtttcaagtgcctagtaagatgggcgcgtcaactcaccattttcctatataatcactagcgtagtagcgttgttcacacaaacaacatactttatcacccgcgaatctagctagcttctacaactccaacaacataaagctaaagtagccttctgcttcagattatcaaacatgaaggtgaaatcacttgcaatgattaataaatagttaaattacaaggtatgatatttatttgaataactcaatctatgtatatatttaaattaatactgccatgcatgaagcagaaaatagttatagaggtgcacatggagagtgacaaatgcagaagcaaggctctcaaaattgccgctggatgtcaaggtgcatatgtcatgttcaataatttccattcgatcatccgttgctaactttgtaagatctattttattttaaatttgattgatatatagccgacaagtctaaatacatagctagtacctagtgtataaatcttgattcatatttcatagactaggtatatctgcagccattttatgtgaacaacattgtgctgctcctttgtcatggccacatatacaacaaattaaaatcttaccgacaaaatttgtcaatattgacaatttttgttactaaaattttagcgacaaatttttaaaaattacatataaattattttttcactattgttaaatttattttatatatatatatatatatatatatatatatatatcaaacattaggtgttcgatcattagcattagaaggcgaaaccagtggtcaattggtggtaactggagtaggaatcgatgctgttttcttaaccaaccagatgagaaagaaattctgttatgcaacgttattaagtgtggaagatgtgaaagaagaagcaaaagatgaggatggccaagatggaggagaaaaggaagatgaaaccacgacaaaggaaaactatcctccacgttgtcccatatgtggcaccaatccttctcctatgtaccttcacgtagcatatgatccataccctaatagctgctccatcctctgagttaattaattacacctcctggttttcttcttgtgattgtatggaaaaggcttttgacctttccatcaaaaggataggaaaaaaaccatattaaaaagcgttatatatgctttgcttaggatatggaataatgataaggttcaaaagtttctgttgggccttgtgaagcccaagtagcatattactgttgccaactaattaaaacggtgcgtattgtcttgtttttaattgttgccatatatattgcttttaatcacaaagtacactgacgttccttttttcattatttggcttttacacttccttttagaaagtgacttcagaagcttccttattctctctcttttcatcttgcgtttttcttctctaacctagctctgctaggatttgctatttctacacaaatcttgagtgtggtgagaaaatactgagtgatgatgatataggttattctgtggtctgtgttttgcgttcctgttactgtggtactgtaggtggatgttctttctctctcgggtttgatcctgttggtgttcttgaggctgttctctgtaaagaactggttgagagaagagtataagattagataatgtctggtcttgatattggtaaagagtggttctcttttgtaccctgtaaatcttgttttcttgcttacctgtgtattttaggctttgttcttattgatagtttaaccttgtaattactgaggctgttgggatattccctattattgtaataatgttaataaaagagtctacatgttctttgtccttggatgtaggtaacaaggattttatcctagttactgaaccaagtaaaattctcttgtgttgttctttatctcttttattttgcttccgctgaatataatctgtgtttgatttatattgtgcgctgataaaactctataagtttcttttgatttggaagtgcatgtatgtaaatagatattttgttatgtgactgaagctagctagtttcatttgctagaaaatctattaacctaaatttcaaagtatatataattaacatggaagtttatgaagactaagtaaattcacgatttaggttttctgccaaaattttatgtacaatacatatacacaaacccttttaataggctatggcgatcacaaattgatgcatcgatccaacatctatcaattggatttttccccattaagaatacaacttttttattccatcgatcttaagcggaaaactctactcttgaaattagtgttccagcaaccagccaatttcttttaattttaagtaattaccataattgtcttaaaaatattgacgttgttttcgggccttcaacgctaagactaaacattagtcccccctcgaagctatttttaaatcatgttgagaatggtcaagttgttagacatataaatgattttattatttatattcagcagcgttatttgatacgaaaatattgtatgaaaatatgagtttttgttagttagactaattaatttagcaagattttatgttaccttcattaggtgtatgagcactcaattttgtctaatatgtaaaaaagttgaatatatatatatatataattattgtatgatgttggatatataatatagttaaattcagtttgaattaacccaatttgtaacataagaatcgaatcaatgaagtttagtttaattgattgattaatattgtgcatgaatttttacaaatttcatagtatttatcatttaatttctgtcaagaatcaaacttgttattattcaaataattcaaccctaaatttaatatattaattacttatcctaatcacttgattatattaaatatatttgaatggttggtaaacacctccaatagcatcatattccacattctcacagcaaaatcaagaaacgcgtttgtctataatgtcctagacagcaatcttctttcgtcaaagaaaattcttaaaagtaaaattaaacaacccttcatttgtctgtgtcctgtatcgatcgatcttaatgttcttctttcctactttcctagaaatttcctcaatttcttagctggccaatacaaataatatcacaaacttgtgtgcttattactgtattacacaagtgaaaaaatacaaataattatcagacgaaaatcataagtatttatagtttaaaaatactaaaaagtaatattatttttaaaatgttggtaaaaagaaaacttttactcagccgccgtttctgaccagcccgtagctagacgttgagtggatttgcgaacgatatatacctacatagacaaataaaactaattttaacattgccatgccaaaaaaaaaaaaatcaaagagaaagatgtaaatgtttattatttttatgtatgaaataaatgtttcaaaacagttcaattaattaactatttccaaaatgcatatggaccaattgccctctttacactgaggtatctcaattaatagtgatgtgtgtgcctatgtgtggagcttaaggcccgagattgtgacgcgctgatgtatgtgtgtgtgtgtgtgttttttttttatggattataagtatgttttatcgtaaataatcttatttaagttagataaaattattataaataataatattttcaataatatataaaagtgtctaggacttatttgtgctagagaaaatgttgttttaactgatatatttcatgatcataaatattattaatatattaaataataaaatactggcaattagtgtaagaataacttctaaaaagataatttgatgtagagtaatctagtctattcaaagtatcaaaatatatattacacgtttttcctccaacacgggtcactccccctctaatatattttccactcaaaatttggaagacatgtttctgtccaagacatgtttttggaagacgtttacatccgttgacaagaatagacttaggtagaagactttcaataattatttctaatatatcacatactattataatattctgcttacagaaatgttatttaatataatatactttacaagatatattattatgatattataaattatatatataatatttataatttattatattatcataacattatattatttaatattttaataaatatttttgtgtgtaaaaattatatatttttattttgaaatatcatgagtaaattatttattatatatatgtatattcattcaatcagattgttccactcactttcgctctcttccttcctatccccctttctttctacccaatcaaactgagggtaaggatttttctttttaattttttttcaaaattttcaataaacacttataagaaaaaaaatgaaaaataaaacaaacttatattttaaactaaaattaatttatatacaagttaaaaatcaacttttaaaaaaaataatataaaaaaatttctacaaactaatttatggatacattagctaattttaatttataatttttatttcattctttttcttattttactctcttctctatgagatttaaatttagacccgtctattacgttctctccccctccttggttgttttacaatatcacattaaaggttgaaattttacaggattttgacttaacttggttgaagaggatctaaattccctttttttcccctaaaaattgcttcacccaatatgtattagaaggctactttttcattttctttaataaaattaaactacttaattttaaaagtttctccaaaaaaatgtttgacaaacttctttctaaagaaaataaagcatatataattaaaattaagttaaaacaaatctaaccatattaaaaaactgcgtacctattgtttaaaagttctttctgaattcaaattcataatccataaatcaataagacataattttattgttgtatcatacttcttcctcccacacatatctaatatattcttaagaaaatcaaatcgaatttaaaatagaacttaaaacacgaggccaagtctttcaaagggagtccacgttcgtcgttatttttttaccttcaaacacggggccaagtctctccagtcatttgcttctttacctttaaatactctcttcactttccaacaaaacacaatattttatcgttaaacgtcacccaatttcccatcacaagtgtaaaatggaagaaggactcaaactgaaaaatagagaaatcaatcagtttccatggcgtcctgcgcaatatgtctactctaagtcagcaaaaataatgcagaaaaaatattgataagagtttaattttccatcgtgcgagtattatcaattgataaaaaattatattgaatatgacttttcaaataattattataaaacaaaattatcatatattaacaatatataattgaataataatgtaatttttttatattatcagtgtatttaaattaagttgtactttaatatctatttttatgactttttatgatttttttgtcgtagagaatttacaggaaacctgtcaaataaggtgggttctgttctctagttttagaagatctcattacttataaaatgaaatttaatagttttaagcaaattataaaaagtatgatagaaaagtattactaattaatatttttatgcaaagatcactgttagatgcggatatataaacggtctcctaattgcaccactagtccactaccacgaaaaaccagaacatcactagctaaagcttctccccaaacataaagctaaagctgtcctctgttttaaattaccaaacatgaaggtgtgagaccacttgcatttgttagtaattaaattattgcatagattcaatttgattcaataataaactcttcacttctgcagaaaatagttatccaggtgcacatggagaatgacaaatgcagaagcaaggcactgaaaatggctgcagcctctcaagatacaattatccgtttattattgagaaatgttacttatacaataatttatacaattgacagaaaaaaatgattttaaatgaataatgtgatggacaaagacataaaaatgactttctacaaatttttgtatgagcatcatatttcttagtgcatgtttagattaaagtttgcaatattaagtttaagtgagacttaagtttgcaaactgattttacaaaaactgaattttcagacaatgtgtaatcatattttttgagggtaactaaacatatcatcaaaatgaaattacttttcaaattgaatatggagttcccaaaagaaaaatcaaacacagcttttattattattaatttcaatttttaattttaagtctaaatagcatatcctaattgacagtacttatttatgctcataattaacgtatatatgctgtttctaattaaggtggccaaatcaaacatacatgcaggtgtgcattcagtggcattagaaggtgaaagcagagatcaaatggtggtgactggagatacaatcgattctgtttgcttgacgaataagtttcgaaaaaagttcagctatgctacccttataagcgttgcagatgcaaacgcttccgatgagcaacagggtggtgctggaggagaacagaaagttgaaacagctttagtgaaaaaattgccaatagcttattgttatgctaactttcctccaccttgtccattatatgtggtagatcatgatccataccccaatacttgctctattctctgagaagactgaaccttaatttctgaaagtgaaaccatccatgaattgaagcacttgctttatgctttggatatccaagaataatgttacaacatttgggaccccaaatctacatgagataacacaatgtcctgttttcgtttactattttgtcaattatatctcttatgtttgtttaagttttaattattttatatatttattctctaattaaggaaagaaaataaataacaataataataataattgtcagtaattaaatcaagccacaaatgttgaaaactttgaccggatagaaaatgtttgattggaccaaagcttaccttatgagaaagctatgtaactttattggatagcatgaaggcagccacactggtaaaactaattgtaggtgccgcacaaaattgtaggcaccgttcaattagagccacaagttgaaaggctattgtctacaattccttcttgagtgggttgtctaaattaatattataatgttttgtaaagtctataaaaggttaatcttgtattgagaatattaatcaaattttcaaattgaaatatatttgaaagaaactctcttcctctctcgttttcgctgtacatgtgtgagtgtatttgataaaattatgtcccattgttatcaataatgataattaaaaattaatcaaatgacatttttttggacccctaaaagagataacagattaacagtatcccgttttcgttttatagaacttgaccatgttggaatataaagaaatccaagcaagatacatgaagaaaaaaaaaaaaaaaaaaaaaaannnnnnnnnnnnnnnnnnngagacattacatgagagagagaaaaggtgtccaacattacaaaatggataagacaggttcatcccttcagaagtcactcatgaatatgatcacctctcttcatatatagacacaaggaccttccattttcactctcttctctctaacaaatccacgcaaagaaaactaaggcacttctctttgattccccttgagaaattaaatataggcctccatcaacacgagctcttatcagtaaccacgctgccagcctccaaagcccaaaccaaaccaacgcaacataccaaattctagaaggaataatcgtacatgaattatcttttattttaaatatttaactggcacttttcatttctcttttatctctttctttctatcacattataaatcctgtcatatttatatttttctcttttttttctttatgtgttggatgtcatttgagatgtctatcaaatatttttctttttgaagtgaaacatatactgaacttcagaatataagtgtttgggaggagtactcgtgtggtcaatcaagtgtggtcaaatcacataccagaagcagtttaatgtaatgcttggtaaaatagaatgaaatacaacaaaaaagtgaattgaaatgaaatttttaaattaaagtaataaaagtgtgagttacacaaaacaaactagtaggtgcaatgtaagacacttcttacttaactatattgtgatggatgcattgaatttacgtaattaactgctacttgaaatatatatttagatgatttctcataattgttatgtatgtaatgatatatgtaaattataaagtaattatcttatctttttctcttttcatgtttctttttgtgattaaaacatataagaattagtttcttttgaacttttatccagaagatactaaaattagttgatttataaggtgttgattgtattttttgtacaaatttactgtaaggatatggaaggaggattgagggtctgaaactgcccgcttagctcaggaccacgacactgggttgtgttttaaggagaaaaaggagggaactgaggtgggacctggaaacacaaacaaaaacacagctaggtcacgaaggagagattcttctacaccttgggagcttgcattttaccatttgttcctcattttcttcacctactgttgggagctcaacaaccaaacgctttgatgtaatgattctaactatctattcaatgttcttttcgtattattgttgtttttatgagttattatcatgctagtggtttgatcatccattttcatgctttattataagttttatgcattgaaaaatgtttatttccttagaactgaaaaaacacttctaagtgaaccaattctaggaatagaatgattttgtttagcctaagttgttcatttttaatcttaatgcaaatcggttaatgtaactcttaagggattatgagcgaaattgggtgatttaggttcttacacttgaagaatcatggctagaatacgttagtagctgaaggtgatcggaaaataatgttgaataacgaaaaatatttaatattgcatcaaagttagtttcggttagttgagcccccaacatacaccgcatcttatttcgaccgacactgtaatatccaactgtttgtatctctttttcttgtatttattctgttttatagtttacattaagttaagtttaattatatgtcatttactctataaaatcaatttgattcattaattgcttagaaacaaacgtatattaactccgggtatagtcaaagtccttgtggaactgacgttcggacttaccgtttaattattacttggacaaattggtacgtttgtcaaagtgttaacaacttcgtggaggaaataagaatataggtagtgatgattttaagttataccaaagattgcttgatacaatgaagaaaaccgatgtaagtacatgaattctcattttgtgacaaatttaaataaattaattcttatttctttgaacatctcttctaagtctgtcacgtgttgggctatgcttttgagacttaacgacaatgtcgtcgacgtagacctctaaattttgtccaatttgttatttgaagattcggtccatcagtctttggtatgtggctcctgcatttttcaggccaaagggcatgattctgtagcagaagttaacatcctcagtaatgaatgacgttttatcttcatctggggcgtgcattcatatttgactgtatcctgaataggcatccaggaaccttagtacttggaacgcgttgtcaactagcttgtcaatgttcggcaaaagatatgcatccttggggcacgccttattgagatcggtagtcggtgcacatttatcatttgtcgttggcttttttgatcatgatgacactaactaaccagatagagtacctaacttctcttataaagtgggcctttaatagtttgtccacctcctctcgaattgccttacgtcgctcttctcccatcttcctcttcttttgtgacattggtttggcctagggacagatgaccaatttgtggcatatgatgctggggtggatacccaacatgtcagatggttttcatgtgaacaagtttgcattcctatgtaggacatcgactatgcgtcagtacttgtggcaggtaaggtccctgttgagatgtgtacattgcccggggttaggttcgagctgcagcttgacaagttcttcaataggctttagacctttgtcgatagtttcatcatgtgaatccacatcgaatacatcatcttaagctcctagacttgcttcatagacggtcagggttcgaattggggtcccttcatctatgctcatgacttgactgttaccaccagctatgaaatgaggcttgtctgactctctagtgagaggatagggagctaccttcaagctttcagcgtagcactgtcgggcccgctttttgtttgcctttacagtcactatctctcccgtcaaggttgagaatttcatcttgaaatatggtgtagagacaatgtcttcgagttcattcaacattttcctaccaatcaaagcaaagtagaaggtatctacatcaacaattaaatacttgattgtcaaactccttgagagttggccttgattgaaagtggtcatgaggtctacatagtctctggtttctactctttctcttgccagatcgaggagtggtccaaagtgtggctagactgtattaggcgagacttcaagcctctggaatgttttccaataaagtatgttagtggagttgccttggtcaatgaggacctcttggacaccatgaaattggcgatcacgatagagataaccatggggtcgtcttgattgatagggttgatgcccttgaagtctctatcagtgaatgttacaggagggagacttcatggctatagtatgtcaacacagttgatgttgatttccacaatggcgtagagatgcctctttcaaaactgactagacagtcctccataggaaaatctatccgcaatggtgttaattacaccttcgacactcaagtaagtacgtgagttagttgagaatgaaataaaaaaggtgagatagaacctggtatttatagagtgagatgagagcttaaggttttcgtttgttgggattattacagtggcataacaatccttgcaaataattcctaacttgtagataagttgtgccctatagatgattgctagtagataatttatagcttgtagataatccaatggtttataaatccattgtttatagataaataagaacctgtcacttgataagggggttataatattatcaataatattcaaatattaagatatttagggataacatgtagcctgactgctaaggatgaaatgtttgtgctcctatatcaagactgacgtatacattaaaataccacgtcacttgacacgtccatttagtggatttctgatatgcttatagcatatagtagttttatattaaaagaatcaagaaatcaatcataatttatcaataaatgctaataaaagtgacaatttttattattttatctttattacttattctttgaatttgtatagcaacaaatcaagaaaagaagaaagaaagcaaaatcaagaagcctctggatttcaagattttgattaaagatttcacaaagataaaagataagagaagatttggattaaagatttcacaaaaataaagaagatttgaattaaaaatttcacaaagataaaagataagaaaaaattttcacaccctaattataaatagggacttaggaggtcaaaagaaaaacagagacagacttgcacaaacttggaggccaaaagtaaaagcaaaacaagaaggagaaacatttttgagggattaaagttaggtcaagaagattgaaattcaaaaatgaggagtttgattattcttcttcttctttaagattcttgatcacttttatctatttttatcaaggctaatcataattatgtctagctaatcatcttctttgtagttaaggtcatcacctcatgtgaacttctttgatgttggattgaattctatgattcttttatgctaaattgttttgtttcaccttgtgttgtatgaattatatatctttattaaaattgatcactttgataaagttcttatggttaggattcacaatacgaatattgtggctttaatttctgacaaatgtggaataacaatcgatacattacctagggataaagatgtatgattgcagatgaatatatgtatttcttaatgcttaatttatgagagatcactaaggaattagggttttgattggattaaagggttaaagtcactaaggaattcggatttaactagtttaacggaaaaatacattatctgaataattagtataattgaatgtagcaatcaatctaattatacaagttgggatcaaacggggtgtgtgtgtcttgactacaattctttctcataattttccaaaaatccaaatattattgctttttaattcttattaattcttaattttactatttaatttcatcaagtcaaaatattaaaactcaatattattaatttttcttcatccaattcaaagataatagttgtgataaacttggtgactcaatccctgtggatacgatactttacttatcaatttattatttggaacgatcggtatacttaccgaattcgcaataattttagatagtaaatttccaaagtaaactaaatttacagtatacttttatgatcagtgttgaaactccagcttgagaacattaacatagaccatataaaactgtagtacgtcaaataaattttcatggcgtgcgcgatgggcaacatatgcgagtcacacattctataaccaaaacacacgcacacacgcatatatatatatatatatatatatatatatatatatataatctcactcgcactgcccatacgatgcatagaaacttgaataaagtattggatccaacaacatacataaagctaaagcagtcttcttcatatatatcataaaaaatgaaggtaatatcactttgtaatgattagttaaattacaagctactctatttatttgaaattatataataagctctatatgaattctgcgatatacatgcagcagagaatagttataaaggtgcacttggagaccgacaaatgcagaagcaaagctctcaaaattgctgctaaatcgcaaggtgcgcttgcatgtgtatcatgttcaataatttgcattccggcttttattacttaaatatccatttcaaatttgaattaataaccgcaagtagaaattacctataattgtttatgcttgataacttgtaattcaaaactagttaatagtgtgtaaatcacgattcatatatagccaaagtatatgcgtttgtcatggttttaaattgcggttgtgttcatggccatatatcaaacatacaggggtgcagtcactgtccttagaagaagaaagcaataatgatcaagtggtggtgattggaaatgatgtggatcctgtttgcttagtaaatcagttgagaaagaagttccgttacgctacgttgttaagtgtcgaagatttagaagaaggaggagatgagggtggccaagatggaggagaagaagaagaacaagaagaagcagaaacagaaacagaagaagtcacgccaaagcaacctcattatgataattaccatattccgaattgtccaatatataccaatagcacctatgttccaccttctccaacgtgtaccacctatcttccaccttgtccaatatgtgccactgccacatattttccaccttctgctcccatgtatcgtcccgcagtttatgattcataccccaatagctgcatcatcctctgattctattgaaaaaacttttgacatatttccatatcagaaggattccataaaaccatttaggttggatatgctgctgagatagtgttgttggacttgataaaatttagattttggtactagttaacaggaaaagttaagggttttttttctttttcttttttaaacagactatatatatagatcctttgttatgaatgaaagctctgtaagaattgttacacttttataggggttgaggacttgaggtactcttgtacctcatcataaatatattttatctttgctgatgaaaaaacattcacgaatcaaaagcgttacactaggctaattaggatatggttcaaatttctttagatttggaagtgtatatgtaaaataacacatttgtaatgtgactactgaagctagtttatttgctatagagaatctagtaatctataaatttcaaaaactatatatagagaacaaggaagtctgtttatgaagactgcagagtaaaggtttgattttctgtcagagaatgtataatgcatacaaacaaacccttcaatatattgaggcggtcacaactaaatgcatccaacatctatcaattaattattgatattttcccattaaaaatacaactattattattttccattaactatattctttttttgggtgtcttgaaaactctagtcttgaaattattagttagtctttccggaaataaagaaataattaccataatatatatatatatatatatatatatatatatatatattgaggttgttttcaggtcttcaagtcttcccctaagactaattaaacaccagtcccttcccccaaagcaaccttaatttaaatcatgtttagcatggttaaattgttagaaataattacgcttggtagctgtcacacacaatgaaaaaaacgcgtttccatgtgcacatcctattcttatgaaacttgaagtataatatgcttatttagtagtattatatatgtagtttaatgtcttggttgcaaattattatccttattagggattacgtgtaatcacaggggatacattttttgtagtcactaccgtttagttagtaaattaaactcggcatgtaaacaaccaataacaacacttcttgtctgagatagtatctttattcaataatatttttctttaaaaaaaatggtacgaaaatattcttgtacttagattgttaataaaagcttcaatttgcatcttatttcatgcccgcttcccaggtaaaatcaagaaaaagcaagtcttcgatcgtttgtcaatgtcccgtatataatatatgctaatccttttcaatcatagaaaattcctcgaaaaaagcaagtattctttgtctctgtcaggtatgtttgtgttctttcgttgaaatttcctcaacaacatgtgaattaatttcatttagaactttcggcaatatcagaatatgattatgggcagaaaaaaaaatacatttcattcacattgtatagtacttatgacgcaaatgaaaagataaaaataattatcaaatgaaaagcataagtatttataattaaaaaatatttcttattttttaaaatggtaataaatatagttttacatgagtttcaagaaatacgttaatgattttatttgtataaaaagaatactcaactaccgtaactgaacaacccgtagctagaccaataaaattaattttaacattgctatcctgcaaaaaaaaaaacaaaaacaaaaaaaaaactaatcaaagacaaagatgtaaatgtttcagaacagttcaattaattaattatttaaaaaacgacgtttaccaattgctttgctctttttcccctcaggtatcccattccttttgtagtcatgacctcgacaaccacttgacttactacaacctagctagtggtacgcacacatgtgtttgttagagagtaagagagttttaattctgagatagtacgcatttcatatatataattctgagatagtattaatactgtactcgtatatatggatcgttattgatgttaatttatgcatcattaaaataacacttaaatataaatatattataattttttacatatgaaatctatcgatataattcatgacaatgatatatttagaagttgatgtagatattaattgtgcatatagatatctgttgtttgtttttagtttgcaattataacaatataatagtgaattataaaaaaaattatatggacaaaataatcatgtttattgttaccaaaattataattaacattactgattcacaagtcatttcataataacaatcgaaaagccataataaagaaaataggaagtatttggaatatatagaatcaaataatttttccagttcaatagacatattctaataaaagtgtatgctatttcaagcaatccaacacaactaaataggtcaattatataattacaaatagttttttagacaaaataacattattatctagttaccaaaaggtaataatacttaagggtgtgcattaaaagagaaatttccagagactcttttgaaaaattaagagtgaagaattaaacagaaaaactatgaatttgtaattgtgaacccaaaatatttttcggacttttatatattttatacaacttttagttttgtattattttttccttttagtagtaaaatataacaaattgggttttgacctatcaaacaagtccaaaactgataaatcaaagctgccattgacttcctgaacctccttttctttgcttctgcaccccctaaagaacaaaaatatccatcatcttcttcacctacacccgatgtcggagaagctatgttacgcctgctttgcaaccgcgtctgagggctacggcagcaaaatgctcaacgacttcaagaatcgcctagtcttagagctcaacaacagcaaaccagtcatattaattcaaaggttggaaagttgacaaaaatttaaaatgcgacagcattctgtaaatccttttccaaaatagtgaattttttttaacattccaaaagggtgtttccagaattgggattttaccattatggaaagggctttccaaccttatggtttcttatactttaatatagataaatttggtcccttaaaaaatatttgaattttttttattgataagaatcaaaaataaatatcagaaaaattacaacaattcatacactttatattcaaccaattaaattaaacctccattaataaaaatatttgaatttaatcacacaaatgattccttctcccatgcaaagaatgtttgcacacatacgttcgtgctctccaacgaaagtatatatatttttgggcaccctctcccacttcctaatttcattatgcttatttgtgttttattcctaactttggacaatatagtattatatacttaatgatttttattttattttatttggggggttaggaacgaattaatggccgaagaacatgatcaagttgaaaataaaggtgaagaaagtgctccatattaacttcatacaactacatactgccatgtaatatcaactcgacgctttttgcatgaacaatttcagtcacaaattttaaaagaattaatgaaatttacatgaagttgctgcaccttgaaaaaattaatggctgaagaacatgatcaagttgaaaagattacggaagtcaactcaaactgaagaaagtgctccattatacaactactggctactgtatgtataatcaactcaacgcttcatgagcaacagtttaagtcacaatttttttcttttttagaagcgtttctgtcacaaattttaaaagaaaatttacatgaagctgttgcaccttgaaaaaattatatttagtcgcatatttgtatacttttttatattttttttatttttaacaattattaacaaagcaataacaacttgtacaaaaaggatatgaaaagtcaaagacagggaaagatagctagcccaggagagaaaaaatggcattctctccaataattttcacgtgaattttagtatattggatgaagcacttctaatattaatcaagtattgtacgagagtttattatatacatcatgtacgtccttgacgacgctgctagctagggctaaaagccaccaaccccaaaagggaaaacagctacaaagtccacgctcttaattagtgggttgcacatgctcatcaccacttttatatttcgcaattaaatatttaaataatagtaactattaattctaaaccatcccttcgaaaatggattggtgcagcatattgcatggtcgcttatgtgttgcccacatgcatgtgttcagaaataatcattaaggtatgtatcaacagaatgaattatttaccacttgtaagttgtattgtttaaccaacgggtcaccaatgccatgccaaagaacagttgcagatagagtatgtgctaactaggtattatataacccttctactggtagaaaatttgggtttcattcctttttaggcgcgcgcagacacaattattagcaaagaaaaaggcctcaatggataatgtattttctctaattgaataatgagagtaagacatgagataagaaattaaaggaacaagttttttctaatataattaaatgttataactaattataatgggtcgttactctttacatattaaacagtttgtatcctttactgtgtcgtgaaatgaatacatattgatcattaaaatttataaaaaaaaataataactaaagcttaaaagattatagagagaattacttttttttcttctgaaaaaatgcatatttatcattatatatatatatatatatataatttaagatgtaatatattatatctgttaggaagaaaaatatgaattttaaaacaagaagggatgaatgtttaacacttacagttgtcacacgaaataaaagtgtaaagaatattttggtaatatttttttaatggaattttaatgaaaaattaaaaaataaaataaagtggcatacactctaatctatcagggaagctaggaagtgtaaatttaacacaagagaaaaggacaatgtactatttatatctttaagaaaggagagtgtaatttacacatgactagttaaatatgagtttaaagttttttttatcaatttatgtaaaattctcaatagttggtattctcttttatgacctctctcatatatcgattgatattctctattattgttaatataatttttaatataattgttataaaaattaataaaaacatatatcacgataagttgtaattgaatactataatatgtaaaatacattttcaatgcaaagcttattttcttgtaattcaaatgctttttaaagcaaaaaattcgttattgaactcaattaattatttgatcactgccttcttcctctacacttcttcaaattaaattcatacttatcaatctttcccaaaagtttaataaaagaaacaaatcctttatttttggtggagcgagagatattgggaaagcagggttttcgtttaattaagcaatccctgattctccaattaccatgcaaatctgatgatcagggtactatttaatttcccgggattttcactaaagacagtcatgacattttttttttcccatttaatatttcctattcaattcactccatcaaacatatacacgaggtcctataagctttccatcaacttcctcataaaggcaccccgcatgaaagaaaaataattgactagtgaattaggagttatcacttattagcatgcatgtcacatattgcacctttgccatttcatgagctcatccaaaataaagaaacacatcaaatctgcaaaagcgcactacaaacttgatagtgaagaatccttggaaactttttctaggcttcctaacctgtccccaaagctactggcatcaaactaaagtgataaaaaaattaaaaaaaaaatacataaatatgtttgagatattgataaacattcgatttttattttgagtctctaataattttttcattatattcctgattattaaatatttgttttgagatcttaaataattacttgacatcatctttataactgattaatcattcagatggtatcacgtcttataataatgacttaaaataaaaaatttaatatattaagaatacaacaaaaatatttattaaagacaaaaaacaaaaattaataatttattaataacctaaaatatatttaaacaaaaataaaattaaaaaagtcaccttaaggacagaggaagcagtaaccacagaaaggaataatagacataaccccagtaacaagctttatgaaagcttatcatctgcaagccatgtgccaaaagtatatacaaaagcaataaaaaaagcatgcactcaagttcatccccttttttatctttcttttacttttgcacagcttctattgttttctgatttagagggttcccttacagctctgcacacagatcatcatgatcaagcttatttctagctaacatgtggtctctccctatatataaaagttagcagtttcgtgtaacgtttaaaataacaccaattcaactttatttatttttatatttattaatgtctaatattgttgatcaagtaagaatgtgtcactttccttattatactttatccaatcctaataataatgtagcttactactccacctatgtgcattggcatatattaatatggttgaggacatctcgtggagaatttgtgaaggctttcacttgtgaacttagaaatctgaagatgggtttcactgaggagttggtaagaagtgtcttctccaaaagtcgttctgatgggtctcatgaaaacaaagtgagtctctaatatgctgcacttattctatagtatctacaaatttacaatagaaaaagcataaatgcacaaaacaactcccttagctcaatttaagttccaataatgttctcattgaagattgcattaaccagcttaatttgaattatggcctgctaattaacaggtgaggcgcaatagtgctgaaaatagaagatggttatctgtgaggtcatacttgtgtggtgatgaattcaattcagtccttgcagagaatgattcagcttcagttaagagctctgaagtcacggtttcacagtccctacaggaggacttgttgaacgataaaggagacactgagagtgaagaaactgtggagaatgtagcccagaacaggccaagttcaaactccaaaaaatcattgagtgaggaagaagcagctgttcttattcaatcaacatttagaggcttcctggttagctcatcaaactttaattacatcaattttcttattcatatgaaaaaatatatcttagtctaagaaaaaattgtatttaagttaaggaaatagtgaaaaacatattcatgcgcttaccttaattgttgttggtactaagttcaaggagtgtatgagattagtgaaaattgcaacactgaacagggaattgagtgtcaattttcacccttcccatttgttaatttctcccatttccattactcaacccttttaaaaattttaatgaaaaaaatgtcaatggttactttttagaatcttagcatataatggtatgttcaatattcatatgattcatagtttgttcattaatcatagcatatctggcttattagcatcactaatatgctgcacattacagttgaggcgtcaaaatggagaaatcaaatcacaaactggaaaagatgagttcaatttagtaacagaaagtccagacagaaagtccatgggcacatcaattgaagtccaaaccgcaaactctacggaagttttctctgttgaaggagaaaagaagggcatttgccaccgtattcagcgcaggaccagaactcaagcaataaagcaaaaggtacaacagaagacaatgatgcattgtgaactagcactccatgattttggttaaaagagaaaaaattaaaattgagatatgctcaagagaataataaattcagaagaaaaggacaaaaaaattagacagaagtaccattatttaagacatcttccagaacatattttaaacttcagatgattaactaaaagagtggttaatattttatcaaagttttcttttaaaaaatgaaaaacaagaaccagaagagtgataagaagggtgtaaagaagatggacatgttaacttgataaatcatctttttaggttaatttgttccacattataaatgtgtctagggtctaggccaactaagtcactagctcaactggtacctccccaacactttgaatgtgatattgatgttgaaatttaatcttccacttggccacttttttcctttttattgtttgcattctccaatataaccaaaagtcaaatatatcaggatacaccttaattggtaattctcacttctcagcaaggtatttctatttcgtacaaccagtttctggcacacatggttttttcttgtttttaatataaagtcacaaccaacgcaaagcaacgttcgttagttttatacatagcacacattgtaggagcatttaagagtctgaactttaactgggacccattaaattggctataatttacaagttacaaccaatcaaaattctgttaagctgcatagtaacattgacattttcaggaagattgggatgacagcacagtaagtagctatgtttcaaaaatgaggatgcagaatagaatggaggcttcaacaaggagggaaagagcactggcttatgctttctcacaacaggtaaacactaaagagtaaacattatatgcacggatagagtgacagtataaacaaattttacactattatccaaatgcgaacaatcatgtacggtaagttttatgacttacaataattaacttaaaatttataataacaatgattctgattagttgataatgtaaaattctttacaccgatagtacatagaaatttaatgaagataaaggcacaggactggtaacaaaacactaatcctgattgttgcagctaagaatctgttcaaagaggaaatctccaaaatttaatagcatggagtcaaatatgagttggagttggcttgagcggtggatggcaacgcgccttccggagacatcatcagttgaaagccatgccatgaagcagtatgacccttctaatggtagtcacaaattcacaatcatgacaagatttttagatgctgctggggaagaaaaggagagctgcgggtcaaatgaagtgccccttaattttgataactattccatcaattcccgagaagaaaaagttagcttcaaaccacatacaccaaagaccaacttcaaagctaggagaactgtttcaaggcggaaaacagtgcctagttatcaattccatgaagagcagccaaaggtcagaatctctttactagttcacatgccatccaagtcaagcctaacaaattcatgattatgtctcaatgattttttacacgagtacactatcattttagtctccgttgttacattaatctctaaaattaaaaaaattaaaaataagttcttggaattacaatctgtcaatcacattagtctataattcaaaaaaatgtgactaaaataatgatactaacatatgttcaaaaaaacgtgactaaagtaatgatactaacatatgttcattcaggcaccaaaataaagataaatagttaagtttagaaacttaagtgaaacaactataaattcatgaacttagttgaaatttctttaattttaaggattaatgtgacaggtttttacatttttagagactgaaaatatgattctctttttttaatatataatgtcatgatcacgaaagatatgattagaatgcatgagcatgttgcttgtgtatctctaccatcttctaaatatagatttttaatgttcccacaggtaagcaaaagagatggttcaggcaatgctagcaaggatattaagcaaaaacaaaagcaagtgggaagcaggacagaaattacattaagcacctcgaaagcttctaatgtgtaacttataaaaaataaagtcaacgtatgtgtctagtattgagatgtaatggtttgattctctagtagattcttgattccataaatcttatgtgtacattgtacataatatcaagtgcaagattgagatggttgttctgatgatttgctttccaaaaattcattcattattaaatagaaaaatgaatacaatcacgattagttgcatgatgggacactaatttttttaactgatcgagaaatgataatgctcaatgttaaaattcaacttcgtatattatttcatacaaaaccaatgtgtgttggtttaatagaaagagtttgaatatcttaagtaaatgattaggttaataacccatcctcgaatcaaaaatatcctcatcatttaccacacgagataaaagtaaaagcacatgattcacgtgtatgaaatcaggttgacgatgatatcataaacaaaaaataaaataaaaacagtgtcatacaaaaatctaagataatcatattatatcagcagtaaagctgttatttaatagtaggaattaaaacaaaatattttaataactaaaacaaaatacaagacattttatatgaactaaattgtcatttaagcctaataaaaataattctatctacgacaactaacgatttctttaatttagaaacatcatacattatattaactttatttttgaaaatcactccttctaaataatacaagaaccatgcgaaccagctttattcagtataacttagaccaacctaataatccctttttccaaccattcaatttctataatataaaacgttaaaaaataataatcataattcaaaatgatgaattgatgatcatatgtctataaaaaaaattaatgttaatggtcagtgaggatgtagacaagttgagcataaatcaattttgtcttgaactagaaaattataatgctttatgcttaagtttaacttattagaagaaaatgttaaacagcacgaatttgtgaaacagcacataaaaacaattactcttgaattcctcgtatacttatctcttctaattattcttttcatttttatttctgaaataaattttaatatttaaaaataaataattaaaaaatcttataacaaaaaataaattatttataaaaaaaataaaatacaatttacataatcaagaatatttttaatacaatttttaattataatataatttatatattaaaaaaatatttattataatttcaattatataaattaaacatttatccttcccaagttacacttcttttttcccatttgctgttggtctatttaatttcaagtggtaagcattttccatagacatgttgtctaaagaaaatagctgtattttactatgattcatgaatggtttcttttggaatgagaatattagtacaaaagtactgttataaaaaaatattataaatattcattgtacaaataactaattttttttagaagaataaatctattttttaaattagccggtgtttgtttttctgttggataaactccaaatcaatttgggcactttggacttttcacgtccctcaccagtgtttctgagtcctgggaaagattttctcccttctacgtttttgcttcccctacgttcctgcaacagatgatcaactccaatttccgcgaaccacaaatcaaaatggcacctttctttgctctgtttctattagcctcttcattgactcaagggtatgctcaatttcaaccaaaaaacgaagcttttatatccttgttgattacccaaaatggccttgactttgtgaaggagttgctggtgaacaaggcaatttcctcactggtttcacttcgattgccaaatattgaaaagactgcgaaaatcccagttgtgggtaatgtctacatggtgctctccaacatcacaatttatcatattgatgttgcttcctcgcatgtcaagccaggggagactggaatttccattatagcttctggggttacttgtgatttgagcatggattggtattactcttatagtacatggcttgtgcctgtgaagatctctgacagaggtagagcagaagttcaggtatgaaatttatcctttattttgtttgtttatatgaagaaagatttaattagaatgcaatttcaaagttattttatactgtcctccgattgaagattgtcagcaagtttgttgatttttataataattatttaaaagtcaattcaagatggtttctgattagttcacaatggcatgcatgtgttgcttgttgtttgttttttgttgtttgattggaatttataagtgttacttgttgtttcattggaatttatatcttaacttgtttaatttatattgtggattttggtatctaacaatgttaacttgtttaattataaataaactgcgccatgggctatggcattcagtatggaatttatatgtggtattcttgttttacttattttatggaaagttcatattcttatattggtatatgattattcttgtttgtatgggatgaaaatgatatcttttttttctttactattatttctgtttatatctgtccatcttcttcacgactgtaatcagaaaggaatttgattagtgctactgttgtaaaggttgaaggcatggaagtaggacttacattgggtttggagaaccaggaagggtctttgaagctgaaactcaaggactgcgggtctaatgttaaagatatttcaataaaattggaaggaggtgcatcttggctttatcaagggtatggaaatatccatattagattcaaatttcgagctcataaaggaacataggtttcaatgtttcctgtatcttttgtagcattatagaacttgtgctggctgcttatcctttctcctttaagtataagatgccttagacctgtttactctgaattttttttttcattttctatttgtaaccagaaaactaaatggaacacaaggtaacattttgtaattaagagtgaaaataagaaatgaaaacagaaaacattttctcaaactaaacagctcgttatttttcttttaggtggttttctcaaggagaacaccttagctcccccctaatcctctatgacagggattggaagcttgctcgatatcataatatattgaaagccctataatccacacaatccgcccttcatcctttttcttaactaaaaattgtaaagttggaataagagataatgttagaccggattatgcctgctgctaacagttacaactaagttcttttgttttttaacagttacaactaagttagggggttataatcccctacatctctcctatttttcctcatataaaccctggtaattggagggcctttcctatcaattcttctctttataatctagtaatcaactgtttcaaactggtcacttatttctagcttagaaacactatccctatctatcatcaccaccaggaggatttttctcctttaatttccaactttttccagctactctggtgaaacaatgctctaacatgatattatttaaaataggatgaaaatataccataggatatgtgttgttgtagttaatgttttctgaaattttgtaagtaaacaatatttggaggtttccatgttccagcatatttagttttatcatcatctattcatacatttccatttcacctttatctggcataaaaatgattttatggtttttgacttttagttttggttaatatctaacaggatagttgatgcttttgaagataaaattggttcaacagtggaaaatgctattgccaagaaacttacaaaagggatttcaagccttgactcgtatttgaaaagtcttccaaaggaggtccccgttgatgatcacacttctatgaatgtcacttttgtcaatgatgttttatttagtgattcatctgtcggatttgaaaccaatgggttatttatagaaagaaaggtttccctacctattcttgacctcgacgacaagaactcgaaacttccaattttatgcacaaattcatcaaaaatgctagggatcactttagatgaggctgtttttaactccgcatcaaccttatattatgatgtaagtttagatgttcgattatgatcttaaatcatgcacattctcaaaatattctatttttatcattggattggctcaaagaaagtgcttactgtgttcaggcaaaatttatgcactggattgttgaccaaataccagatcaatctctactgaacactgcaggatggagatttattgttccccagctgtacaagaaatacccaaatcatgacatgaacttgaatatatctttatcttctcctccagttgtggagatttcgaatcagaaagcaggtgccaacatatttgcagacatgacaatcgatgttttggaagaagatgaagtaataccagtggcatgcatatcattggtaatatcattaatatttatgtgtatgctttattcatcaccattctgaatattactaggatgtactagatattatgttatgataaattctatgggctggtgtggatgtaaaatgaagttcagcaagcttaattgtacaacttcgagcagctctctttcatacccttttttctattaacagaagctaatccatatcagtctttgttagtacggtcatttatcttaaaacttggctaatcaatcttccagtctgctggattggcttgttggtcaagtggtcaacagtccttgctaggatagtaggttgttttggctgcaggctatttgtgtttgccctgtatgtaagactcgtgaatatttatcagtttaagggattgctataaatgattgcttcaactcaataatatatttttgattattcaactacaatgattgcttggtaagaaatagacaattttttgtttcctctaccttaccctagcatcgggaaaagctgagtttaaagaaccaatcatattagcagtttagttttgtagtgatgttgcaattgattgttattcaaatgaaggtttaaatgcaattttagtccccacattttgttcgatctgcaattttggtccctccattttaaaattaagacatttggtccttctattttaaaaaatctgctattttagtccttccatttcaaaaaatagagacatttagtccttctatcttagaaaaaaattcgcaattttggtcaaattctcaattttgtctacattttatttcttttctgaaccctaaacctaactattcagttaatgtaccattaagaaattatttaattagttacaaagtaagaaaataaaatgtaagcaaaattaaagattaaaccaaaattgtggattttctaaaacatggggaccaaatgtttctattttgaaataggggaatcgaaattgcggattttttaaaatgggaggaacaaatgttttaattttaaaatagagggatcaaaattgcaaattgagtaaaatagagggatcaaaattgcatttaagccttcaaatgaattactaaagtttgtcataattagtattagtaaggtgctacttttttttttagatatagagtaaggtgctactttgtttttgtgtatttgtgcaaggaatatattttatccagatactatgtgtatctattcaaccactggcggatagggggcacataattaaagaataatcagcttaaaataattaaagctaacatggtgtggtagactatgttagaatattaggaatctcattgtgttgggaatcttatgatgttagtataataaatcttattgcaccagcatatactagttatgagtttttaagtataaataggtattagtgctttgcatcacatgctatatttcatcagatgccaattattcagaatctcttattttccttttccatctaaccccccataatttaaaattggcattggagctgtgccaccctccatgacctaatcctgtcaccaacacagctgccgaatttgcaaagtttatcagatcatgtattgcccctgtttgttgttgtaatgaattgttcctttacgatgaatgaccgctatggctacattgcatcttgtttacacaggtaattcaaggtacaggtcttgtcaaaatcaaaggaaacaacctcgtaggttctatcagattgaatgactttcaaatgtcattgaaatggagcaacattggcaatctgcggatgtacctcattcaggtgcctttatgtttcatgtttgtataagtcgcgtgataacaagtactaaaattttaattctaaagtttctcattaatgaaggatgtgttgtcttttcctactgcagccagttgtgtggacgcttattgaaactgtcttcttgccatatgcaaatgcacgtctgagtaaagggttacctttgcccatcattcatggtttcaccttacaaaatgcagagataatcttgtcaacttcaagaattgcagtttgcagcgatgtagcttttgcagattcaaacaagcgttttcttcaatttcattgagtacataaaagagtgtgtggttattgttcatggagtgtaaatagttcaaatcagaaatcaagatgatacatctacttgtgcaatcttatttcatttgttaattgctacttgctgggaaatggggctgtcatcaatacaaactttgatacaaatacttgcgccgccagttatcatgtaagaagtagaggtttataaaaccttgcaaaagaacattgcacatttggattagagttagtatttgaataaatttgaggttacaaacttggttttgattatgactgagtagattaaaatcattctagaaagcacaaaatttaaacaaaaaatcataatacaccaaattattgctccataaatatgggtccataaaagaaggagacagacatctccaatagcaaagtgaaggttcttatgtaaaaaaaaagtcaaggtccttattagagtgtttgatagagtgaaaacaaagtgaaatgagataaaggttttaaatctaaagcaaagtataaaaatatatatttcacattatttatgattcatttttttttatattacaaacaaagaatgtcctatatattataagagtatttaaggattttacatgtcctatataattatttaagaacttaaaataaatttcacatattatcttgcaaaataattttaatcataagaactagttacttatataagaactaatttttgatatcaaactccttcatcggcaatccctcataaaaactatcattgtgcaacacaattatgtatttcttatttagttttttatataataaaaacttaagtttaaaacataaaacatgttttgttgattacttgattctgattattttttctccctaatatataaaatttaaaatataatccaaatcaattgcagtaaaaacatcaatttttattttctaaaatagaaaagcgaaaagaaagtagtaattatttataaaagagaaagagagtaagtaactttaaaattaaacaattttcataaattctaatactatatcatcaaccctgttttcactaaaaaaatactaaataaatacattgtaattttattttttttgaaaatgaatcatttaaaagaaataaaaacaaaaaaaaaatgttcttcaaaggtcaaaacgacagtgttagcaagttaaccttatcctccaattccatcacaaaagtaccggtggttcaggccgacaccaacgtttttaaaacccacattaaaccctgctttttctccctctctctatctgttccaattcacagggaacaatgcaaatttctcttagcaacttagccttcaagacccctcaactcttcccaatacaccaccccattttccctccaaagccaccactgaaccaccaagtttcaacgcagagccatgtcatcaatgtcctgaaaggttcgtcggggtatttgtccgaaatcagcaaagcgattgatcacgaagaacagtaccgggtagcccggtcgcaggttagccgtaaagttttggacttggaaggttattccatagagggtctttcagttggaggccaagagacatgtatcataatccctgagttcaagtgcacttttgatattgggaggtgccctactagggctattcaacaaaacttcctttttattactcatgctcatcttgatcacattgtaagattctccacttttgtcaccaataaccttttatgtgctggtgtttttgctttttgggattagtaaaaaggggggaaaagggtaaattacacatgctctgtcttatcttattaggttgtattgattattgacagaaaagccagccaattcatacttgattaacatggcctaaaggttgtttagtatggaaacaaaatgtcttgtttttattttctgctttaagtttatatatgaaataatgaaaacataaaataatataaagctattttcactgtttcttgtataaagttttgaaaatggaaaataaagtgaagatactgaaattttttgtagttagatgtgaaaactgaaaatgaatgtagaaaaatgtttcctcaaaccaaacagtgccttaagtttttaatgttagaactcaggcctatttgtggttgtaacttgtaagggatcgttgatggcatacataggcatgttgaatgccaattcgattttagaggaggtttgggttcaagatgcattggaaaatgggattttagtaaaccaaacacactctaaaaacaacttacataatctaatgctgctctttctttttggaaggcatcaaatacctgtgaatgtgcttttgcatcctagtaatttgtttgtaagttatatgcattctgtgtatcctgtactttggatgtaaagtgtaaatttagcctaagggtgtgatgattttgaatgatttagggagggctgccaatgtatgtagctagccgtggtttgttcaatttgaaacctcccactgtgtttgtgcctccttgcatcaaagaggatgttgagaagctgcttgatattcacagaacaatgggccaagttgaattgaatgctgaagtggtcgctttggatgtgggtatgtttcatttgtcttccgttaatgatcaggaaatatcttcaaggaatgacgtgtgaaatttcattttaggggagacgtatgagataaggaataaccttgttgtccgaccattcaaaacacaacatgttatacccagccaggtatcttttgatctgcattctgtagcccttgtcttttaaatgaagggtatattatatcagttttagaagttacctcattccttgtacaaaaacttggcccaaaacttaacaggtttcagtttaccatatttttgttgtcatctatatgaaattttgttaagaaatgccatttgggcattcccacattttgtctgctgaaaacacatacatgttttatgcagggttatgtagtctactcaatcaggaagaagttgaggaaacagtatgcacaccttaatgggaaacaaattgagaaattgaagaaatcaggtgttgaggtttgtaatattggaactcaattctgatttaagtcttctttgatctttacctttaatgaactctgctttctagattaccgacatgatattatcgcctgaggtggccttcaccggtgatacaacatcggattttatgcttgacccgtgtaatgctgatgcattgagagcaaaaattcttataactgaggtacgatacaatcttttagtgaaatgggtacaattatttcatctcccaagttcagcagactttgagaattgacagcttgatctactgaaatccttataaatagagaatagctttagagattcagatctcaagtatgggacaataatatgtaagaagttttagcatcaattatcaaatcagccttcaagtctatttcattccataaatggacttttaatttagtcgttccttaactagttctttatgatgatcatgtttacaacttgaggtattgtcatgggaattttaagttaactttttattttgtgcttggttatagtggaattggaaggaatgaaaacaatagtgaaaaggatgagattataaatttttatggttactagttcattgataatctagggggtttctttccttgatggatataccaaaagattgcatgcccttttttatttttggttatgaacttatgactttcctgcttgctttctctttatgtatttcctggcagatttcttatccttttctgtcatagtccttttctttttaaatttgcctttccttttaaaggaagagcaaggggggggagagaagggtttcctgcttatcatcctttcctctcattttttttaacaagccttttcctctcttattgaactctcttttatatattaaaaagaaaataattgttgcttgcctatacaaaagtgaagaatatagaattagagaacgggtgagaggctacaagtaaaatcttgtcagtaataaatcatatttaatgattttaatcttatatgggatattctctcttttttcttttttctcctttatgtttaaccttttcttaatcatttttttctgacaattaattgtgacaatatcaattaacagtgaaatgaaattctttttattgtatcccaaaggtttgtcttcaccagttcacctaagttgatatcatcattacttttaaactctgctttacttgaaaaaggaattaaacaatttcaaaaatgctattgccattttttgtagtgtgctctgacttctttattgctattttatttttctcttttttgtgtgattgatttgcttgttgaacctccgttaataggcaactttcctagatgattcattcagcgtagatcatgctcggcaacatggacatacacatttatttgaggtatgcaacatctttcactctgtcatggctatttatagttagcttgaccaaatcaaagatgcacaaaggccagcttttgcagccctctcatacttgccctttctcttttatgttgctgtcttgtatgactgaggcagtgttcatgtttaatgcatatacatacttatcataatgttttcattatcaacagcttttgtgccaaatgttacagaagagttcaaccaagtacatagcttattagtcatatactatgttgcatttatgactcattttcatgtcatttcaagataaaaacctggagtctctacctgctcagacaaattctcagaattatgactctactgcatattatatttgaggaattcccaattagtaaacttatgttaattatgtagatcattgcaaatgcacagtggattcgcaacaaagcagttctgttgactcatttttctccaagatatactatagaggtaatgttatagttttccttttagttttttaacttgcaaattgcatcccccaaggtatcatatctgcatggataccaattagatgcaaaaatccaagaattgtgtaagtgtcttaaccttcctcttggaggggggcatattctcttgtaccaccacattaaatatgcattttataaaaagacaaaatttagatgcaactccttaagtgtttttgttggtgttgttcaatcagaatttaaaagttttgccatgataatttgtttaataaacatatgcgttaaaggtcagcacagattatcaaaaagaaattccatttctgattagacaccaccaccaaaatcttttaagaaattacatctaagtttgtccttgcattaatgttaagaaatttgtgcctcttttttaagatacgcatttacattcttgatcctcaggatattcgtcaagctgcatcaaaattgcagtccaggttgtccgctaaagtggttcctcttacagaaggcttcaaatctatgtactcttaagtgttccaaatcagtacatcaacgattagagaaagagaaaaaatgtcactagttgtatctccgtttcatagtttcttgtaaattagaggtatatttgttttcagttttttttaattaaattaaatttaacttgtaagctttctatattagcgtgaatgagtagtcactacccttatgtaacttacaattacaattggtacaaccttaaagattatgtttcgcccaacattaaagtctgtttcatatgtatatgcaataaagcattggttgatagtgttttttgcctaataataagtttgatttagatatctaaattgtcttgatgaaagtgataatttagttcggtccctcaaaagaattaattacgccaattttattgttgaaagagagaaaaagttaccaaatagtcttttgaaattataaatgtggaacacattaatcctttaatcatcttcttttacttccttttattttaaataattagcttctagaagagcaaatcacgtatcattagtccttacaaaaattattagtgaccgaagttgattctttaaaacgttaaatagacgaaaaaattatatagttttatgtctacaattttacaaaagtattctatttatgtagaagtaaattaggttgagtgaaatttttagggactaaaatgggtgtctaatcttactttcatctatgatgatttattatacgttgattattttttatgaatactctatcccgtttatatttttgttcttactgtcaaactttttgggatccaagttttctaaagtagataatttattttaaagagtataataacaaaactcagttgatgaataatattaatagttaatatttcatgtacatacataaataaatcatgaatgtgttaaaatattaatttttaatttctaactaacacctaaattacttattattcacataaaattaattattttagagaaatcatttttgtttgtgtgataaatccaaactcgacttacgtaattgaagtgtgtatgataaaagttatcataatctcttccctttgaaaaaatgaaagtcataatcatgtcttcattactttccaatcatatcagcacatgttccagaactcattttgctccatagaaaaagatacaccgtaatctaactaaagatagcttgtacgttacttctcttttttcttttttatgaattgtaccttcttcattataatatgttcaaagttcaaacccgtgtggttcatttggcccctaaaaaatcatctctaaattcaaaacataataaaccaaaaagtaacatttagtctttttaaaataagattgaatgtattttttttttgttagaattaggttacgagttaagtcagtccaaccaaaattttcataagattttaagtttttcctttttgaaaattaggcataaattataatactttttacttaattaataagcataaaaagataataatattctaatgatagctataaaatttgtttagagctgtgaattataaatatttattagttctaatttcttaattttatgacttagctgtgtatagtgtttaaatttatatatttcatttaaacattgttatattcagtcctaatctagtcaaaccatacctaactcagttcatcagtcgaaaaaaaaattccaaagtaagacgttttcttcttcttgcatatatgcaacaaacactcactcatcatatgaactgtgcaaatataaattgatgtgtataagtgtaagtgtgtaatgtgtgttttatgcaaggaaaatatttttttataataaaattacaaaataatataggcagaaaaatataatataaccagcaatcattttgtataacgcaacggtgtttttaaatattgttaaaaattcaaaatatattataatcaacctattaacgaatttgaatcatcattattgagagtagaatgacctgtgtgcatactctcttgagtgagtttcttcatgttgtcgcttctaaacttttatattaaattgtgtccatattttcctctttaattaattattctttattgaaagtttgaaatgcttgtatttatatatttttatttatttttattattaatgaaataattttcaataatcagtcctcttttattttaatttatattttatcacatttgacccgaattgacaaataattgtatagtgtatgcgatacttgttaatttaatatgtaaaactagagtgtaggtaaaattaattgcatagttttgaactaaatgtggaaattaataaccaaaatttagaaatgcccgattctcttggtccactgcattaatttcatgcatattttgtattttttaaaatactttttagtttattttttatgaaactacaaaagtagttgactatgatttatgttagagagcgcctttgaacactgtcaatttcactgcaatagtttcatcatttatgtatgtatgaaatcataaattatctttggggtgagtatttgtaatttttattaaattaattttgaattgatacgaatgtttgaatattttattttaaaaataaattaatagtaaaattcagtatattttttatatataatttaaaaactatttaaagttattctgatacaaaattcattttagaattaaacgtaatatcccaacctaaatccaaacacattcaaattcaaattaaaggaattcatcataattgagctagctagttgtgcgatcatatttggtaagttaatttggcagcatttttctatgtaagctgcgccaaactcgtgccgacattcgtatctaaggactcatttttgtggggccaaaggcatggaacttgacctatcaataacagagaattgacataaatttgactatgatatgccaaaaaacaacacatcataaatggataaacctctccacaaaatcggttgatagataactgaatatattatgtgaattgattaacattttattatgactatgtatgtagaaaggatttgttacttgaggcaaaagacctatttggaaaataaacttttctatcgagttaaaattaattttatactataagttaaaatctgcttttagaaaagttaaataaaaaaagtttttatcaattagaacatatataacccaactttttttgtgttatacttttctttttgtacttaaaaagttataaattaattctttcaagtgttgaaatctatttaaaaaattgtcatattctaataggtgttcttttatatacacgaatttagagattgaatcgcttatcatatgcctgagagaaaattttatctattaactatatcaattcatatgtattattattagcatggttttaaattaaattacacagcagatgtgattatattactgatgtcccgtgttgtccggatgatctattatcatatatgattcgattaaagggggagaattttattttacttttttgtcaaaaatcttgataatcactataaatatttttttctttgataaaatacacagagacataatctttgaaatggcgatgttaggatttaaaattctaattgatgacgttacatgtaaagtttacctgaaatactaattcgctttcactaccaaacatattaggtaaataacttgtttgtttagcttagctaatagccaagatacttttacaatataataataatagtataaaacaaaatgggcttgctcttgcttcaaattaaattactctaacattgacttaatgtgtatttggatctattgtttttatataaaaaatacaactttcttacagaattattaaaaaatattatttcattctaattatatttctaaatttccttaaaaaaaactacatttctaaatatacataaaaaaattatatttctaaatcaaggttcaaaataaaatttataaaggctaagcacttagttttgttaaaacttaaaagaatttaatgatcaaacacttttaagttagtataacttctaagtttattattataaaaattaataaatttatcatacctaaaatgagttataactgaatgataatatatgatttttttacactgttaatgtatcacctattttattaaatttaaaagactttttaccttaaaattaagcataatgtaatttcaaatcaaagttataggtacaaaagtagtttagctttattaaaacgctcaaaatgaaagtatcgatgcttaataaccaagtcatgacaaataatttattttaaaaaaaagtaaaaacagtaatattttgaagaaaaaaaattggggagacgttttttttcagtcggtgaaaactttcttgaaggagagaatttatttccattataattgttaatatgtattgggcacagcaagctagctaatccgatctcactacaatggtagttaggttaaaaaaatgacacgccaaaaacagatagtattgacttaactcactttacttatgaaataggtttgaattgggttaatatgttagaaagaaattgtaaaatgaaaatagattaaaactatttgggaagacatcaatcctaatacttctttgtccttcgagaatggtgcctattggtgcaatgagatgttagttggcttaatggtggagttgggcatccaatcacaacgaaagttggctctctcacaatgaccacctgcaaacactgatagttaagataatagtgattttatcatagttttgtgtttggatgggaaaaaatgtatttatatgaagtcatgggtgaaggtacttatgggggggaaagggaggtgacatgaatggatagatcattcattagatcatcttgttagtcttttattgcttttacattagtttttgagtcaaaaggagatcaacaatatgtgtcaagagaaaatgcctataatttatatcaccaagtccatgcttaattaaaaatgtgcacattttgtggtctgagatgatttggccatgcaccaacaagataaactaccgagatgccatcctgggtgttgagatgaaagtgccctgtttgattaggccaggtccttagaccaatattattgggcctaagatgggaccataacatatttttctacttaattactaatatttccttttttcatactgagttcactattcattgatgaagcatcatgtttcattcatcatcaactagagcgacgaactaccatttgtgaacaatgaaatggagtacaagcacactacttgaggagaggttaaaacaattatatttcaatttgagtgttagttatggtgtttagagatttgaattttgggtaaaaatatgtaggatttgtgtgttcatgaaataatgagatttgaactaaaaatagacatatgaaataatagaagaaataaattttttaaaaatatttatctgttatatcttattcttacattaatttcgaccttattccttatgcaataataataataataataataaaaaagttaaaatcaatgtaagaataagatataatatgtaaatatctaataaaaaaattcttttattatttcatccgtattttatctttagctcaaatcttattattattattattattattattattattattattattattattaaatgttaatattttttcctacttatagcaagaccttttctattttttctaatccaattttgttaactttcatacttcataccattatcacctaccacacaacacattttatatatgaaaatacatatatctatatcaatttgtagtatacgtctatacgatactatcttcttttttttttatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgactaggttctttttataaaactaatctaaaatattttttcatcaattgtttattcacaaaaatatacttaatcgttagttatttctcattattctatacatagtaattaggatatattaatttagtctaagttacacttttagtattttattttatttttaaaatttagtttgactctttatcttttaaaaaatttaatttaatttttttaaaatgagtcaaaataactatttttgtcatgtttgttacatttaacattaaataattcatattgacatttttttggaccgctaataattgttataatgaggccatgacttataataagtataaataattttatagcgattttaaattccaagaaattgcttatttctctctaatctagcactagagaacaatcgcacatggttgcgaagaatcctaaacacatgaaacaacgaatcctaccaaattgcttaatcaaatagcaaaattatacactaatcaagtacaacgcctacaaaattaagtcaaatcagataacaattccaattcaaacatgaagccaaaaaaaatgatgagcaaaagtactgactgttattacacagctgctgggataaaatcctaccctacaaatttaagaagtacaagggagaaatggaaaagagagatgactcgttggaagtatgcttaattcatctttctctctctctctatatatatatttattgatttttatgattaattcttaataaatttttattttatgttgagttctaatagaataatatttttactttttgtcttgatatttcgttttactttctaataaataaatgatttttttagacttattaataataaataattttttaaataaatataaaattcatcattttattaaagactaaaaataaatgtcaaggaataaaaataaaaatattattttattaagaattcaacacaaaaataagatattcattagaaattaaaagaatatatttcttctttattatacttgatgtaatggataagactattttaacttattctaaaaatataagattaaattgaatttttttgaaaaagatattaccaagaatattaattgatgaattaaaaagaaaaaatattcactatgaaaataaaagtataaaaaaatatacaaaatttactaaaagaaaactagaagaacttagaaaaaaaatatttaatatatcgattttataagattttgtataatatgtaacagatgaaaaatattttaataaaatataagtaaatcagtaaatcctttagagtattttagtataagattttaagtaagaatattaagtttaaaatttaaataaaaaaggtaaataaattttcaatgtaaaaaatgagttcttgaagaataatttttaaaatttataaatatttaaaaaataaaaaagatcttcaattttatttaatattatgaaatatataaaaaagtgatataaaatcataatttaattgggatctagtctaaattaattagttgtgtttagtgtctcaaaatatacacaatttactaaaagaaaactagaagatagagggggagaaaaggcttttcgagttatgatgaaaggatgaaaggaatcatagattatttacccgaaactaagagggttgagtgtgaggcaagttgtgtttttacgagatctagtctaggataggagaataagaaacctggattggtcacgtgccaactaagaatctcgaagcccccaaaatccaacaactaatacatataccaaaaaacttcaccgctgtgtcatccatcacccatgaccatgatccaatccatccaaatccctctctataatgccttcatcaaaatccagtagtaggaacgaaacgattgagtaatcctaacttgatgatactagtccttagttgataacattattatcacatcaaacttgcaataacaacgaaacttcctaacaatttctctttctctctgttttcacttctctctcttctcttctcttctcgtctttacatcacaccctctttcccccctttgccaaagctctaatattttctccctccaatccccgctactccacttttcttgatttgggtgtctcgttttctcagttttgaatcgtttttctgttctgggtctttctcctcttcgaaaaggatctgatttttcgccctgttttgattcgaatccctcgtgaaccctctttctcgatctgggtgtgaaggaaaccgttttatccttcaattatgaggaaaagggagagggagaatccttgtggcgtgtgtggccactatcacaaatatgaagaaggggaagtgtgttcgatttgcggtcaccgaattccggttggatcggagaaaacttcgatacaagttagtgcttttccatccgttgttctgccggaatttctttacctaggaagctacgacaacgcatcacgctcggagcttcttaagactcaggggatttctcgtatcctcaatgtaagaggggtgttattgtctttttgaatctggcatctctgcgatttcaatttttcgatgattatctatgaatgtatgcatgtgttgatgtttactgtggaattgtggggatgctggttggttaaatgttgcggggttttgtttttgccttgggttattatgttttgttgtttgaggtttcagtttttattgagtaattgcaggtggtgtgttttacgttaggggtttccttaacaatactcttctagtttctaagtggccaatgatgtttgagtctttattttcttatactaatttttattgagtaatttgtaggtggtgtggtgtggtgtggtttgggttaggggtttccttaacaaatactcttctagtttctaagtggccaatgttgtttgtgtgttaatacctttgaattttatgtttgtgcagaccgtcccttcttgtcaaaatctctacaagaactcgtttacctatcactgcctcccagatgacaaaactttgccatttgatgaagcaattcagtttcttggtatattcttttgtgttcattatacttatcatttcatttgcttaggtgcttctttaacatggatttgcaatttttaattaatacctatcaaacattatacttgcacatagtattggaactattggaacatcagcctactcttcatgcttaatacaaataagtgatctgctttgtgatcttctacctttattgcatttgttatttcttatttttttcaaaaaaaggtacaggatatgttgtatttctgtcatagtggttgattgttcttctaaaagaatggacacatttcctttcacgatgcctttcgcacttctactttatagattgctctatgaaccatctagtcaatttatgtactattaacaagctgtaaatggaaaagaaaaggcaattgtagaatcacatagacctgggatgtttgttcttccgggtctcaaacttatctttgtacctccacctcaaaaaccttgttcttctgaaactattctcacttaggttgcaataagaaattacttcattctgttacatttatgaaccactctactcctctctttgaaaccaaatgttgcctaaaattacaatttcgtattttgtccacttttacctatctgtgagtgttctcaaaaggacccgcttaaagtcaatattgaagaaagattcttcagcaatttgattatctgagagcatcctggccatctatcagtgtatcacaataatttgttatattttttcccctcatcatcagcatctatatccatgacttcaagttcttgacatatttaagattcttttaggggcttagactttcccaatagtgcataattgagttggagtaaagtagaaagctttaatctatttttcttatcagtgagcaccatactgattgtgtactgagataaataccatggtgaatagtggcgtggagaccccccaaatgctatagtgggataccggatgaccaccattttgactccgacatagatttaaattacacatatatatgctgaaaaataaaaaaaaatacctaaaagtaggtataaatctggaaacaattgaacagattcaatgtaatgcaattagtataaacaataaagaaaaagaagtttaacactcatgaatctggaaatgcaagaaagcttccagagaaaagagaaagtatttgaagaaaaaatcttggcctgtccaactaggttaatcttctattgaaaaccaacttgtcaaaattgagcgaagtgggaggctttatagccaacaccaactccatgcaaatgggaaaaactgttattggttcatcgttgaagccttaggtatttgaagctgaattgggcgctgaagagaaagtgtagaagctagggctggcgggcaccaaagaagaaagtgttgaagaaagaaaagggattctaaatataacattataggattttccaattttacccccataaaaagcataaaacgacacttaaaaagggggtaaaaatctggaaacagtggaacagattcaatgtaatgcaattagtataaacaataaagaaaaagaagtttaacactatctggaaatgcaagaaagcttcaagagaaaagagaaagtatttgaagaaaaaatcctggcctgtccaactaggttaatcttctattgaaaaccgacttgtcaaaattgagcgaagtgggagatttaagatttatagccaacaccgactccatgcaagtgggaaaaactgttattagttcatcgttgaacccttaggtatttgaagctgaattgggcgctgaagagaacatgtagaaattagggctggctgggcacaaaagaagaaagtgttgaagaaagaaaagggattctaaatttaacgtgataggatttcccaattttacccacataaaaagcataaaatgacacttaaaaagggggtaaaaatctggaaacaatggaacagattcaatgtaatgcaattagtataaacaataaagaaaaagaagtttaacactcatgaatctggaaatgcaagaaagcttcaagagaaaagagagtatttgaagaaatttttttagcctgtccaactaggttaatcttctattgaaaaccgacttgtcaaaattgagtgaagtgggagactttatagccaacatcgactccatgcaattgggaaaaactgttattggttcatcgttgaagccttagttatttgaagctgaattggatgctgaagagaaaactagggctggctgggcaccaaagaagaaagtgttgaagaaagaaaagggattctaaatataatgttataggatttccaattttacccccataaaaagcattaaacgacacttaaaaagtgggtaaaaattctcttcttgcccgtaacactgggagcgactgcagacagttgtgaagggcatgatttgtgctccgattagtgcagcaatgactgcaactagaagatgtgatacaatagcttcacaaggagcgggacctacccgtgacattgtgatggtgcaatcatgccacgaatgcacgctattgactattctgtgatagacacgtgttatgtgctgcctagtatagatagaaaggtgctgtggaccagagatcagggtgtgtggatgctctggtgacaatgaccctttgttctctaactctgtcggtaaccgtggtgaggtgataggaggtgaaacacaccctagatctatagatttagtatgaccagttgccaagtagagagaaaaaggggtggctgaattttttgttgttgcaaatatatagtaattaatgagagagaaaattatgaagagccccaaaagttaatgttcatgaaaaggaaataaagatattattggtcttacaaacattgttttacaaatttctgttgttaacaatatattttaggttattttaaatgttgatcatgaatcaaaggtttgtgatatgttttgattcatgattcccagataggtcttttgattcacaatttgatgaccagtacctcgaggcaattgtcgttctatcctaaattgtctttcaaaatgtctaagccttattgaaattgtgataaactaggtaattttttgtggtttttcacctattctccgaccatcctttctctctgctaatctgcccccatcttttctcctccagtattgttaatagttgatggggagacatgtttgtgggcttgtattgtaaactttgttgtatttccatcattgcataattaatatctaactaataaattcttcagtgtattaggcttgatttgaactttttatctctctaaatttttttctcatttggtttagtttaaatggctgctattcattataacattccctgtttaagtttagttttatattcaattttgcatatatttgttttccagaatgtaatcagcctaaaatgttgacaacattaatgcaatatatgagtaacacttcctatgctgttattccttgcattgagttataacatttgatttggctaattgaaactaactagtaatcaatagtttcttttttttactattggcaatactattttctccaatatttcttcctttttacccttgataatgaagtgagtgctgtgtgcttccttttcagagcaatgtgagaaggataaggagcgtgttctggttcattgcatgtcaggaaagagtaggtaagatattgctgcaagcgtgcaacatgctatcataagcatgacggttacatttgaattagttagtgatatgaccctcagaaaataaaagggaattgatataggttattgtactgcagcctttcaaatgaggaatgcaatatacaaatgctataattttctctgaataacatgtatcccatggcaggtctccagctattgtgattgcatacttgatgaagtccaaaggatggagacttgcacagagttatcagtgggtaaaggaacggagaccttctgttgaattaactcaaggtatgtttgtttactgtttccatttttgcttccagtctccagtaaagccatcagattgcagtgttggtcaattgaagactcttatctggccaagttatttatttgaagaccattatggaaacttcatcaaactaaaaggaaaacatttgcacttccaatctgtccacttgtttgaccatctattcgctattgtttttcctttgttaagccctgtgttttctggtgatccactaatgcctgtttgttggttgggtttcaacaaaactctttctttgtgcccttgtctgtcgtaggactgattcatgcacacatcagtattttctttttttctttttttttttttttttttttttttnnnnnnnnncaggtcacaggttcacagctcactaaatttgattgcatatgttcttattgttctattttgttttttctattaattttcatcacctttgtttctttcccttattgttcccttatacttgacttctgtcattacattatgctttagataaatggtgtctggactctggactcttgtcattttttactattaatggctattctgctatctgttttcccactacattgttttttggggtcatacaggattgacaactatgttttcacatgcatgtttacaccatgaccgtttcttcaaaatgaagcaaccattttcataccgtaatagaatatcaaggtttttaccctttggtaataaacaaaccatcctgttggaattggcacttatgtatgttttttctatatcaagtagtgaataatttcagggttcgggtgcctttcacgaggctaattatcatctttctaacatccatgcttccactcttaatataggtgtgtaccagcaactgcaggagtttgagcaaaagatctatggcccgatcgatagtggaagctctctgctgcctggtttctcgcctacagcacctccttcaattagctttggttttccaaagatcaatgatccagctcaacttccttccttcagcactgctggaactccttcaatcttcgcgcgagcacctctagaaattgctcctaccgagtttacattcggcaccggtcagacccagaagaatgtggctggaaatccctttaatgcaaatccagcaaatccaaatggcactgatatccaaatggatggttcttgattcttcaccaaccgcttgtgtgattaagctgcttgacaatttggcttgtggtaaagtttgcaaggtaccaccaggctgccatatttcaagtcaaggtgcaataatcataagtgacttgtcaattctacaccaacttcttttttccccatgtttttctcaaatcttttcatagttatctctggttgtagtattgagatacagcatatatttactggactcagtagatctgcgcgacaatatccagtttttaatattagaattaaaatcttatttacaaggtatacaaatagtaaacaatccagctgtggaaccgctgttttgaaatatagaaaaattcatggataagtttttgaaattcatcatcagttttccacctttattttttatcaccgtaccaaactaaccataagatgcttattatttgagactgaatgtaattttctgatcttgcgttttgtcccattacgtaagcatattaagttattcacgtggaaccgtcaacatttcaccacttatgcctcagtcatctcaccatcaacattaacattattatgtactctatcattcactttatgcctaatcaggcccaggtcaataatatatggtgcattaaagtcatgttctacatttatggctgagttccatgcaaaagccttgtcaattcatttaatagtacttggcaatcaccatttttccgtggtttctctcctctcctcttatctcaaaagcatgaacaagttcctgtatctgttctatatttcttgccctttcggtctttactgttcaagtgtctacatagcatttcaaattagaccaaattgaagtgtgttttctttctcctgcaatactaaaattgcatttctatgttttctgtaaagggaggatgagccttgatacaatgattaagtgtttgtctgattttacgttggaaacttctaaatgatcattgaataaaaagtttttaattcttacttatgaaatatgcatgagaatatttgtctgttctaatgttaaattatatacatccaaagttgccatctcatgctttgaatgtcatatgtttaaatctgggaactaaccttcctgtttataagaataaggttggtaagcttccgattcataagaaacaacccaagtcgttgattttttatttattatgattattgataaataaaaaaagttgtatggaatcttcgttgctcttatcgtttttataaaattgtgaagatataaaataaaaatataactccttatcaaacaagttcattaaaataaacttgtttttcctatcatttttttagttggaggctaatatatgcttgtcaaggttgcctctctccacaataagtctttcaaatatgagcataggagaaaacatttactaagggagtgggggacccgtgcatataaatagtcttgtatctaagtagctacttatagtataggaaaatctagtgtgattaaatatgaaaaagagtgagattattaaaacagttttattatttgtacagtacattacgtgttgcatatttttttctgattaaggtagaataatttcatgtcagttcaacacgtttgatgttttttttattataaaataaatgatacatatataagtaatataagtgcacaaggagtgctggaatacataaaggactagataactccagtacgaggtaacaaagccactgtaacgccccgtatgcatccggttcattaacattgatttatggtcattaagcgcagcaattatcacagataattaaatttggaagcgataaattaaatgacgtcatcaagcatcattaacaacaactgtacatcatatatggtgaattcttataatatataatatatatttcaaaactatacaaaatccctatcaggatacaaaataacaggcataaaacaaaagatagagccaacatgctcttaaacactatgcctaaggttctcacaaaacctatccctgctcgggcctcttactctgggatctctcagcagctctctgagaatcacctgcaaaacataacccccaacaggggtgagataacaatctcagtaaactcagggtccttggaggtctttcctccctctggttcacttccatggcatataatatcaaaattggcatttcaaactagtaatcacagctatcaagccatattaccacatgtacataacatatatatatatatatatatacaaatatatatcaatgcctgaggaggcttcatccactatgtgggcacatctcacatcaggactttcattcttgcctgaggaggcttcatccaactacgtggacatatctcacatcaggaattttatatatagtctaataaacataattctactggccagagaatctcatcaatcacatatacaacactatcacagtgttcagctcatcatatacacattttcataaaacagtaacacacaatttcaatatacatgcatcatgatatacaataaccatcactccctcggagtatggtggaacacaaacagtggaaaacactcccaagaacaaagagcttacctgctctcagcgctacaccggctctcccggcttcgtgatcacaaccaccagcaatgtctgtatcacgccctacacaaggcatacaaacaaccaatcaataacggttctcaaccgtttagaatgaaaagaaacgtcattcctttccattacacctttttgttccctatcttaaggttatctgaactatccaccttataggcgactcacagtccctcagcaagatctgtttcagtcttatcaaacactagagtcactctaaaactctgcataaaccaatttcatgacctaatcagaccatatttcaaaaattatcaatatcatcaaactggttatttcaacactttttcaccgtttatatggtctcctgaacatattttgtaaaagcacctaggctcatacatgtcataataccctccatttaaccaacattcgtactactcatacatatctcagagtcaaagtcaaacttcataaatagttatgattcaaagttcaatattcatcagaacagcctcctgagcatacttttctaaagaatccaagcctaattctagccctatcacaaaagggtcactattcaccccaagaacaaattctcaaatcaatcggtaaaacttgtgtttcttacctctaaatcgacagaaaaggctagagaacagtttttccaagcttgagcgtccttaaaacgtcttcttttctcctcagaatcaaactttatgaatttccctagagaactagatctctttgtttgatggttttcagaaaaaagtgaggataaaatctagctcattgagtagttcttttcaactttcacgttggatgtgaaaggttttggtcaacggttgagtgtttaagaagcttctctagttcatcaatgacagaaacagagaaaaggaagaaagaaaagagaaaaaagactaaaggagagagagaaggctattatagtcaccaccaaaaaataaacactaactgactgccacataagaaaaaatcctgacgctaactatgccattatcatctttgcatatgcatattgaatatgccaatatgaatcccatagtactgtctactctgcagtggcagagtcaaggccaaatcaaaacaatgatcatggcatgacctaaagatatatttttttaaaaattttatttttttctaataattatatatacttatataattaattaaaattaaaaataaaatttaatactatctaaaaataaaatttgacattatttaaaatttcatattacctaaaaataaaacttaactcggtgactagtctctgaacctcaatttgcatatttgcccacccacccggcaaatatagtaagaaaacctgcaagtgagatgtgccctcctcttggctattgcaaaaagtgcaatttgcatcagccaaggttctcaaaaagattctgttttgtctgcactctaccctgcataattctccacactaaaccctgtatcttagaaggaaccggagtgctccatattaattaagaagcttttcctcctcccaaacacgttgcatataaatagtcttatagctataatatatcccaaaattaaaggaacaacttttcttttatttctgttgtccttaataaaaacccttcgagaactcatgcgggtttccccaacacaatcttgttggttgctgttatcttaataattcaacatatattcactttctcccttcccaaataaactataaatagtataaatgatataaagtacaattgaagattagatgcgttcacgcatttgtaattgttggatgaagctcaattgatacatattttaatctgataaatcaaatttaaaacacacatttgagatcttaactatccgattttaatccaatggttacaaagcatttgactccgtaaatgcgtgtaatttctgagtgcatgcaggctatccagatcaatgaattaatacatcgttatttctcatcattgaatgtgcattcacgtacaatgctacagcaattgacaacagcatagaaagcttttaacctgcattgcagtggcctataattgcaaagctggtgaagtaatatttaaagtggattgctatatagctgttcacctagctagctataaatccatgccaaccgaaaaggaaacagcattttcaaatcgcaatagtatttttattttctggatcctacatacatttaaccaaccaagaccataaagaagaataaaattaagctaaaccaaccaaaatgaattcctcgtatcccacnnnnnnnnnnnnnnnnnnnnnnnnnnnnnnnnnnnnnnnnnnnnnnnnnnnnnnnnnnnnnnnnnnnnnnnnnnnnnnnaacaaattcttattctagctagcatgttttgaaattcgttgggaaacgaaggaatcacatttaggacattgaagctataactgacagcttctgaaaatcacatccaaaacgtgaaaaatcacatctgagatgcgaaaccaaacacgctagaatcacatcaatgccccaagacattgacattgttgtgtgcaacatttggagagtcatcaccatcatcatgatggaaatgagaagcaaccttcctcacttcccccttgaaagtgtcatcaatatcaccatacaatccaagagagtcatcttcatccgtgcattcttccactcctccttctgggtggctggatccgcacccttcactcggatcttcgcgcttcacggcatgaatggtcggaccatcgtcatcgttgccgctggcctcggtgcccttcatgcaccacatgctaacaatgagaactccaagaccaaaaacgagcatgcctttgctatatttggccattgctagcacaagatattggtttagttagtttagtctttgagcgagtgataaacaaagttaggtagaaaagagaacgtgggtaatttaaaggcaatgttgtttactattatgggagcaatatttaaggttgtggtttagactttagagttggaactgatcttaaggtagatccacttgaagctggaaacatgttatgttgtgcgtagtacaaggttctaactacacacgtgggaagtgaagttcggctatttttaggttgaaacttacgtgtaatgatggttaacgttgtaaaagttgcaacaatatgcacaagaagttgcaccgaactaaagatgtgtcactgtgcatgttgagccacttgtatacttttaagttcaacgtacgtgtttgggaaaatttatttatatgaaaaataatgttttatttcggaagtttgtttagagaattgatacacgttgaggtagtaaatattttcgtaaaagttgaatcttcatgttagtgttatcaattgcttacattctctaaaaaaacaaaaatggaatgtacatgtgtgtgattagattaatattacatctatctttttttctctctctctcgtcattctcttcttccgagcgtgtatgtatatcccattggagggtgaaaaaattacttttgtcataaaaaacaatgctaatatattatcgccattggtgaatatatactattattgtgatacgaagcttttatattgatccaaattaattaaaatgcaacagaatggttttcattaattatataatgtgtaaaatacattcacctcatttaatttttatcttaatagaataacaaacggtgccagagattttgtccttgcacccgacctctatagtacttagatataaatactacctaggttccacctttccagcatcaattttactcaaaatttggtcaaatttgaatcccattccataaacatatagcagctaagtgagctaactgaaaatcacgacgaattatattgagtcgctgaccccatctcatttatttatttgttattattaattacttgtagtacattaattaaaggttaagttaggatagaatagaagaatagtggcttggtagaaagttgaactttgtctagagattgtaccgggctgtctgcccaacgtatagtattttctgttgggcctttggccctcgtttacacccccaaaaaaagggaaattttattgatttatgtttcatttggacccaaaagtttttcaatgccacttatattgtacgatataactaatttaattagaagagaccagggggttggtttgtttaatacttaatacttactacttagtaggtagaagctactgcacatatttaataatttttcatatccatggtggtatctatctgatagttgtaggaggcagttggtatctatctgatagttgacaccaaagtagctacccagtgtgaactgagccatggtggccacacccagctggcaggggtcttccatcaacctcatgattttgttgcacctattctgctttaatgttgccagttagaattcaatataatgtaatggcttctctaacatggctttgcacaacgtttacaatttagaagatgaacccatatatagctatatttatcttctcccctgccatcctcaactacaccttacccaatatcacactgtgtgtcttcattttgacaaattttccttggcacatcttgcttttcttatgaagtattttatttttataaatcatagtaattaaagtccttgactctctagtaggacctcaaatatctcaacaaactttgtttcattagattagttatgaaactaatttttgattcagaacttaattatatttaaaattcattgtttttttttccaaaaatttattatgaaattcgctcttgccattctcatttaattccaaaatcatctctaatgaaaagatcattaatttaaataccaatataaaaaatcttaaatccgacagaaaggaaatttcatttaaaattttaggtaaaatccttaaatttttatccaagtaagaataaaaaaattgcaacatatagactattggtattattttttttcttttgcagccataatggtacgatgatatcagtatttttttttatttgtaggaatcaaaaataaatattgaaaaatttaaaataatttatatatgacgtttaagcaacttatttagattccttatctgatgacattgctgtgattttgtgattgcaatatctaacttataaacgagcgaacaaagcatttaattagaatcagtgacattggcaattttgacctctgattttaagtccaatttttatatatccatgcatctattttaattacaagtaaacaaataatttaactactatgaacaaaataaacatgatagtgattgggcgcatatcacactcactctattatcatataaaatttaactatattgacacgaccaaattttaattttgccggtgaactgtctcgaaagtctgaattatgaaaggaattccctccaaacaccaggggcgtgtatcatgtatgagtagactaatacctgcaaattacaatccccaaaattgaaatcgaaataggacttctaatataaattaaaatggcgatcatgtcaagatcgataaaacctagacaagacactaaatgtgtgtttgattgtgaagaaatagaaaaaattggaaagaaatttttaaaaaattatgtgtggattaatttcacacctctctaatataatttaaatatttcttaattttcttctgctttttactctttcacacaatcaaacttatcctaacggactgtttgacaggaagaagatcataagatggataaaaataataggaaatagaaaaataagatgaataaaaatagatgagagataagataattttaggaattaatatttgatttgagagaaataaaaaaaataaagaagagagaaataagaaaagataaaaatcatttgttaattgatttttcattcaaaaaatagtttgttatttctgcggacacacacatgtaactatccacaaattttataagtatccatatgggtattcataaatatttgttaaaaataaattttaaatagtgtaaaataaaaatattttgaaaaaaataattatactaaaaataaataattttaaaacatatatttatactacaaataaattagagaaatttacttttgtatataagaacatttaagtaatttcaaaattgtgggtatccgtaggtacaagtaccttactatttttaagattatgctagccctcatcagttcatttatcctcctttttgtattgttgagatactgaaataatatgagcattctttcttaaaaaaagaagtaccttactatatttcctcaccccactaataagcaggtattcattaatgtatccatttttaactcgtagtaggttttactcacagatatatacgggtgcatgtttctaattgttgccatctctaccttctctattgcaatctatatactacatgtgcaaaatttaataatgtggttgctcacattatttggaatgaatttgataatatataaattatcatatctattaaataatatgtaacatatcattatcctttaaaaaaatgacaacatatcattaaattataataaaaagtattttttttaatatatatcaaaacataatatcaaatactcttttggatccctattataaggtttaattaaataattcattattttttaaggaaattaatattatttttttcaaatattacaagaaattgtaaagattaactgatttttcacccaaaataatcaacaagttgttggttgttgagtggtacaagtttggcatccttaagtataaagtctcaagtttaaatattgtggatgaaaaaaatatgatgaagatagaagatcacactaaatgtaataagacaggttttgtagcgaaaatttatcatcaataaaatttgtgtacatttcataccaattaatgtcatagtgataaaaaaattcaaaaacatgttaattgtttttttagaatgtcttagtaaactttaatgtatatcttgtttttcacggtttaaatttctatctatccaaatggttacattcagtattcagtatttcactattttaaacagagttgtattttataaattgggagttgttaggaggaatcacataatgaatatctacttttgcaggagagacaacatctctttggacaatccaatttgtatttaattttatgtaaaatataattaattgatacatagagataataatggatgtaatcttccgtcaagtttataatttttctctatttcgtaaaataactttccgtcaatttatatttcatcacattaagtcttgtttaattacatttttccatgtaaatttttgtctatatctacttctctttgtgtcgaactcttgataacaaactttcattcttatgagagcattcagggtttgtctcattatctctatattcccgttcatttttaggttttattttcttccatttttctctcctttcaattttttaaatcttattttctttccttttcctttttattttcaactttttcttatctatgattgagttcatctattataaaccccagttaatttgtgttaaagatgataattaattgacacatgttgttcatagtacacagaatgtgataccactatggaaggaattagagtattacaaggagtatgaagccaaattgagagcccatgttggtgtagaaaaaagccaatgagatcataagcgaagcgttgtacttgatgagcttgggaaccaacgatttcctcgaaaactattacgtgttcccaacccgaagacttcacttcactgtgtcacaatatgaggactttctattgcgtattgcggagaatgtcgttagggaattgtacgcacttggaattaggaaattatccataactggtcttgtaattcccgtagggtgtctccccttagagagggccacgaacatcttaggcgaccatggttgcaacgaggaatacaacaacgtggctatgagctgcaataagaagttggagaaagttataacgaagcttaatagggagcttccacaattaaaggcgttgtcggcaaatgcatattccatcgtcagtgatatcattacaaaaccttccacatatgctacgtaggctatctaatttatttgctctaacttttgttgttcttttaacttctatatgcactatatatcttcaaggttttaaatattagttacagtcatattaaggtttcttcatatttattgatattgtgatacattacgaacaaatataacttatgcgattcaaattactatcgtggacagttaaaacaatcttaatattgtagcccaattaatcacgattgcaaactgtattttctttttaattatttttttattgcgtagtagattttaaattaatgaaatttgcgcatcatacatgtgatgtgctttaacttccgtatctaacctgtgggaataatattataaagtactgcagttaattgcataattaatgcatgtaccaaacaacggggtgcccttctcctgattgaaatcaaaacggtatgcttgctgcagatgttctccttcttcaaactccgtttctttttttaaggcaaaatatatattaatagatagaaaatgtacatcaacctgtataagttgtacagtatgaactctacataccaaaagatatccccatatacagacccaacaaaccaatcatcaaactcttctccactattatccagacaaaagaaaaggtataggctaactacaaaaaactgatagacactgtatggggctgttgcacccagaagagaaaaacaagcctggtttgtttcccttgaaactttgttttgactctcttcaaacaaaaataaaaacttgtttttgtagttttaatataatatatatttttaatgatttattattattatttatttgattactaactttaagatactaactaatactacttatcttctcttcaaaaaaactaacacttatctttatattatttaaaggacctgatatgtaacaatagatggttttaaaggtgatatttaatacatttaattaattgatttaaactatttaaaacagtactattacttatattgatactaatatacgccttattaatttgggaaattgaactttatgctggtacaattgtcagattattattactattattattattattattattattattattattattattattattattattatatatactattaattacatatatcacactaacaaataaattgatttttttttttaaagatcaaacatgttattaaaaatttaaaataaagtgtaatattaaaggaggtaaaaattataatttattaaagcatatattgagagtaaaagtcaaaaagcaatagtactaaactataagttaataagctgcttcatctaaaaaaatattataaattaacgagataagttcatctattaaacacttctattatggtcaaagaaacttataaattggtaataaaaaaaattacaaagtacacaggcatcttgaaggatagccaacagaaatagggttgttgttttttagttcgtatgcattcaattaggaaatacaagaaattgtatgcatgaagaggacagctgaaacataacatttaatttccgataaaggtttggttcaattgataaagaaaagatcgatccatgatccataactcataaacatgaaattttattgttgatgtagaaactttattagtaaataatacataagtatttctaaaatcattctttgaaacttgagactttttataagtctaatgagtcctagctaggactcatttaattacctaaaattttgttaaatagaaaaaaaaaacataacatttagttctaaattttgtgtagtacacaacttttaggtttgcttttacttcttatcataaatactaatttatgaaggtagagaaaagctccaacacacaaaggttcagtgtggtacatcaaccagaataggtggattctcattctttatggatatcattgcatttccgaattcaaatttatcatcaataaatcacccagacataattttatcatctgttgagactcatcctcatatatatatatatatatatatatatatatatatatatatatataaactctttattcactaataaaaaaacatcaaccaaccaaaatggtagttaattttgtatccagagttcacacaagatttattaacaaagttatgcaagcatatattttgttttcaagagaaaataaaatatgcattgacaatataaaatattgttgctcgttcagtttatatgaatttcttgatttattaccacaaaaacctacataaaatattgaccttgatatggatattattaatttcaggatttgaggttgtagctagagaaggcgtgttgttcgacgggaacatttgaaatgagctacttgtgcagtgacaagaatccacttacatgcacagacgccgaaaagtacgtgatttgggatgcctttcatcctacggagaagacaaaccgcattgtctcaaaattatttgattccaaagcttttagcaacctttagatgatgatgatccattattttccatttaaaagattacatagtcttgcctagggcgacatcaaaatatacatatagcgagatttaatgtcgggttgccatgcttgatttgtatacttttttgtgtgttcaattgttataaaaaattaattaacacctaatcatcatgtagtcatgtacaccatatttgacctctgtaccttctcatgttatactgtccttgggtttttgcttcgctgattcttgtatggctttgccaacttttgatgtttggcttttttcttttttatatacgcggactgtaatgttgtattttattaattgattgttcaattaatttaattaaattatatataagagaaatttaatttaagtacttgaatgaattagttaataaatttggtgattttatttcatgtatatatgtggttagtgagtttttagcgttttggacttaagataatgaattttagtttatgtttagagaggcgagtatgtacaataagactttggtgtgaaaataaaaaattacaagaatcataaactctcctttaattttcaaaaatttgaaacaaacacaaaaattttcattctactctcttctttctctccaataaaactcattcctttaagagttgagaacttgattgtcttattcaaatgatgtatttttctcttctatttagtgtttattggttgcctttttgcgtgggaaacacctcactttcctattttatattcgattttcgattttccctagaacacttatgggggttccatgaaaaaggcttagtttttggatttgaatatgactttgggtttgttttgagtatggataatgtccttgtaatttgaattgctaatggagttgaagaaagttttatccttggatccaaagttccttccttatttctttttcttcatctcaaagcaagttcctttggttttatagataagggaagctttatcctttttctatgcttaggttgcattggattgctttaaatgttgtttgagaatgaaccatgtttaaaaatgaaggtttgagcttttgaggtttgaaattgaggtttttcattattcaatgaatattgatgaaaatttcatatttgtaaagagttttaatgttgtttatgtattagaattgatataaaaatgtttgttttagaaagatttgaaaatcataagagacaattcaacaaaatttcaaaattttgcaaaattcgcatctactgatcaatttcgtgtccactgaccaattttgagcttaatgaccaatttcgcatccaataaccatttttaagtccaatatctagttttgagtccaatgactagttttgagtccaataactaattttcagtccagtgaccagttttgagttcagtgactaattttgaatccaatgaccatttttaagtgcagtaactaattttgaggtcaatgatcaattttaagtccaataaccagttttaaagtggatgtgattaatgtttgtttttcttgtgtaaattaattattttgagatcttaataaatttatgatgatatgagatgtggttaagatgatgttgttttattattagagttgacttgatgttgagatcatgagatttacattcatatgagtttttggtaagttgtttgcaagaattcaaggtgttgacatgtcttgttatgcttattgaactatatacggggttcacgagtgtgatgaacatataaatggtgaatatgtgatattataacctcttatggtattgagattggtgaatgaatttgtgattacgtatgatattgacttgaatgatcataacatgcttgcattgatgaatgacattgcatgtaagtaggcacataagttggggtgctaagagggcccttaacctagtgttggaggttgtcgtggtggctgacatcaaatgagcatatagaatggatgagtaagcaatccctaaataggttaaggtctttgcaagttttgctgaggtaaaccactacctacgctcattcattttcgataaaatcatacttcctccccaagattaattcaattttcccagaatggtcagatcatatagtgtgactttgttaagggatgtacttggatcaatcgctcaaaaggtgaaatcttccaggaataaagagtcagcatgatataacatgataagtagtcatgtgcactgataattgtgtctgaagactgacgtattacttgaagagatatattagtacatggttgttggaaaaacgaaggatttctgcatatctttaacatgatcttatatttctcttatatgttgttttcttttaaaatgagtttatctttacattttctattgaactataatgatacatgttacttctgagaaacatgttactcgtggttgatatggacttagggatgagatccaacccttggtcttattgttatgttttgtcttagtgaaaatcaactcaggatatatatatatatatatatatatatatatatttatgaatatatattgtatttattcatttaatgagacccttgagatttgtttataatattttgatgatgtaatgccttgggacacaatacttttatattttatgaattgagtatctttttatggatgaaatttatgacatgcttgtatttatgaaaaatattatacgtattaattaaattaatttgagaattttaaagggagcatgtaataacatttgaagtcgttacatggataatataattagtgggaagtaattaagaaaaaactaattagaaagaactttacaaagaaagtactaataagttttaagattttattactattgtttaataaatgtaatttgagttgatttgtttataaaatgttgaataatttaccttttgagcattaaattataacaaattctatgagaatgtacgcaatataacatttgataatataagtttctgtttttttatgggcaaactaattatactacgagagtagaagggggtattacaatcttaatataaaagaacttatctagaaaagggaaaaccagggtgaacctaacatattagggatatttttacactaacgagagaaaaaatgttacccaatttaccaaaaaaatcatgaccatatgatctgacctatattaattagattcaaaagcgtaaatttgttgaaggcaaccaaagagttcaaataactgcatgttgtatttgtcaagctttgttttgcacttcttcctaaaaacaatctaaagaatttacaccccaatcagggggaaaaagtgtctcacccaatatatagtgatgtacaagaaaaccaagaccaagatttaaccactattagatccaaaagccaaagaatggaaccatgcctaaaaatgatagcgtatgagaaatatatagtattcataaatatttgaagaaagtgtaaccttaattaattaacgctcgaccatgagaatacagcagacaaaacttcatgaaacaaagtacatgttagcatgatgagattgatgtgtagtacttcactatgaaaggcaaaaaaacataaaacgatcgatcctgctagacaaccataagattccttttgagtaaattacttctggttagaatttgattccaaataattttccaagagaaactaagactctagaaggggcatagcatttccaaaactttctaaataaggtcaactcagaattagacaaaaaaaaaaaaagctgaataagtatgaaaagctatttcgcaaccacatatgtgcatatttagatgaaaaattcccacagatttccaaagaccacacccacatgtcatacttatccctagctaggaccacatacctcaatatgtcaagcaatgcagacatcaagattttctcttaaggctttgtttgggagttaggaggggaagggaaggaaagagattcaaagggacgagaggggaagaaaagggaggaaaatgagagaagttctttcttccttgtttgagagttaaaaatatattaagagagaaaaatggaaagttaataaaatacttttacaattttgctcttacttcaaaaattaacacattctatattttacaaataaaacttaattttgaatttgtagtttgggtaagatagtaatttttaatggtttggaggaattcagaggagttttaaaaatcctcaaattcttttcctcaaaaattaaaactctcaaacaaggaaatgttactacccaaactttttctgtccctcccttcccctctaaaatctctctcccaaacaaaacctaaaagaatagagacctcctccaactaaacaaccaaaccaatattcaacaaaccacacctcccaaaatccttgaacttgattaccctgcacctaaaagtggaaatacgatacaatctagggaatagatcttcgaagctatcatttcccaatcaaatatcgtcttataatctaacatatataatataggtaccacaaccagtccttttccaaacaagaggaaaaccaaccaaaagaaatttcatgactgttcagcttggatatatacatatatcccaccatcaaagggaggaatattcacaattaaaacttttgacaaaatttgtcaaactggcattaaaatgacccatacctagaacaaagaatatttatctaaaaaaccatctgattcagacagcaaccaccaccgccattttgctaagtggtgtaactttaaccattccttggacttaaaaatcactttccaactaactcaagcaaactttcttttatcttcaatagtcactaccaccaaaaatcgagtcaaaatatttaaaaccttccttggcatggtagtagaagttacaggctactcaacacagaattcataaaacttaatatagctacctcaaaagagagacgtttacttttccaagatcccaacttctaccccaaattaaaaatgaatatcaggcttccaatttgctaaactcttaggattagcaccaattgaaaggcctagatacttactttaaaggagtactactacctaaccatcatcctcattcatatgcaattaaactacttttatataaagttaattttaaggatataaagctggctcaaagcacctcaaaaatagaaatctacctgagacatttatatgtaatttccctttaacatctcagtagtcatacatagggttacattacttttgagtaaaaaagattgatccacgtgatggaaatggcagtagggatagtgcgcaccccagacaagacccatttaatatttcgcagccccaaagttcaaaacaggtacaattacaacttaactcttggcttgaggcccaattaggaaaatgcaatttttttgcttcctgcaccccccaaaaatacccagtcaaacaaaaataccctcatcaggcacccctgcctctcccaagcaaatcctagccatcaaacctccataatcaccgcatcccacctccaaccaaccacccaatagtatactaccgccgcaccctaacaccaccactacaaccacccaacaccaccacacccaccttcacccaacacaaccgccacacccaactccttctacaagaccaacccaatatgtattgtcaaagttagcattgtcgacgttgcaatgaagaaggaaccaagtagtactggcccttctttgttcacacttctaatgttgtgtccttctgacctttcaccctaataggtttgctacactctgaaccctcataatttgcctcaaacatggctcgctaaccaatattttgtcaccctattctgaaatagatttctggattacacactttcaaaatgatcattctcttataaaagaagggtaatgtgggaattttaaaacattcgggatacaagaagcaattgctggcaaaaagtagctattagccgtacaaaaacgtagcaacataaacataatttattataagaagaaaataaattataccgatataattttgacaactattatattattatataattttcaactaaataatgttttcctaaaattcatcgtttaattgaaagtttctttcatatagatcacatattcaaaatttcatattaatccaaaatcatttgatatctcgttcatataaattaaaatcgacgtaatataaacatttcaaaatatattaaatatggatcatttgattaccttcttattatttttcaattttgacaaaaaaatgatcttagtaatatgtcgatataattcaatgattgaatcgataaaaattatattatatatcaagttataaaataagtataatagttgtcaaagttatattgatgtaatttcatctctctttatttattatataacaatgtaaaaaatatttgctctattaatttatatatatatatatatttatatatatattcagatattagtcaatagtaattacagattttcagtagtttttttttaaaaaaataaacaaggtttaagtcttaaaaaaaatgttaagcgcgttttagtttatttttttaaataggttcattcatcttaacttgaattaaatagagatgactattagataggaataattataataaaaaaaaacttgaaacgactaatcttaatgtatgcattaatttctttcctttctttaatgaaaacctataacaatactgaaatgtgtaatgacttatgactaagtctgattatgataattaaatatgaatttgatggtatctgtatgacttgtcctaactttgacgagaaaaattcattttaattagaatcggatttgaatttgtcctaacttgtaaaagcaaggttggagtcgaatgtaaactctaccctctaacctgccccctgtgcataagtgtgttagagttaggattttttttaattatttaaaatataaattaattctttttataggtgaatgcttataataataataataataataataataataataataataataataataattattattattattattattattattaagcaataaagttaaaattaaatatttaactaaaatataaattgattcttaaatttatttatttattaatttttatatattgtttgaattaaaatgtgattaataatttaatatataattgatttaaaaacatataaaaaggactattttttaaaaaaatataagaataatgtttggtttatatttttcattcattctttttataaatccaaactcattgtacattttataagtacaagagtggaaagagtcaaatcagcacagcaaattgatctgaagggacacatccctaagattttgtttgggagatgaattttagacggaaaggaaggaaagagaaaggtttgagtattaatatccttgtttgagagttttaatttttgaggaaaagaatttgagtatttttaaaacttttctaaattcctccaaatcattaaaattgttgttcccccaatttgggagtttttagaaggaaaaataataaaattactatcataccacaactacaaattcaaaattaagttttatttgtaaaatatagattgtattaatttttgaagtaagggcaaaattataaaagtatcttattaattctccattttcctctcttaatatatttttaactcccaaataaggaggaaagaatttccgtcattttcttccatttccttcccctcctaactcccaaacaaaacctaagtgaatgaatttagaaatattttagaatgagtgacacactctttcaacatattcttttattagttaaaaatgataaaattttataaattttatatcatatttaaatgattatttctattaatttttaacttttaataaatttaaataactaaaaaaagtatatttaaaaaacattaaaaaatttattgctaacactgctcgtgaatttaatagcattgatagaattgccgagggtataagtttacctatccttggcctggttattcaatgtgtttcttgatctgtctaataattcaattcaatttatgtttcccctaaaaaaataatattttcttgcaaagactctggtcgttatatgttgtctgaattatatggattgtgatagattcctatacatataaatgttatctagaagtccatgtgcagctagatggaattgttgacattttcgtgcatatgagtgacttatttatctcttttttttctttcaaatgttaaattaattttgaggtgcttatactgtttggcgattttgaaaattctgaatattttaaaaatttgtgattgaatgtcagaatatttttaacgtgcatgttatcgaaaaaaaaaaaaagagaattgtttaaggtgctctaactcttaattttccaaaaaaaattcccgcgattaactcttttgatttccaatagtatgctaccaatgcaaagcaattcggaatcttgtacaagatatattaaacattttacagaaagctatttgaaagagatatgagccaatacaagaatccaccctttaccaactaaccatataatctttttcatcaaaacaactatatatatataacacaagtatttaagcgagttctcatttgaaaattctgcataatcccccaaaagaaaaggcacattattcctttaatatttgagtcctataaaaattagtccactaaatttaaaaatgtgtaaaataatatacttaatgtactggtttacaaattattcatacgatacgtactggtttacaaattgaggatgcttgattcagatccctgatcccactatggagattaatgttttcagcttaataagaatcattacttacaatcattatttaggatagcattttttttgtgtgaatatttaagataaaatttaattaggatatattgatatcatgagattttttgtatatgataatttaattgacaattattatgtatgataaatttattagctaatttttataataattattttaaaaattatatttaagattatttttaattgattagcaatgaaaaaaaatagatgacttttacagttatatataatactatatatgaaaattaaactcttaaataaaatcctaattttaccctgcaaattatcaaggacttctctctatcagtattatcgatagaaaaagtccactgtaaatcattgaaaattcaaatcattcctcattcttttctatatctctattttaccaccaatggccaaataactaacgagaaagtccactgtaaatgaaagtggcattgatgaaatcatgtgtaaatgcatcatgtaattgtttgtacatgtacacgtaatatattcatgaattaatttattaactgtggtcactcatgagaatatatatagttagagattgaggaaaagattgttatgcataatttctgcgtacgtactggtacctgagttatgcatgatttatgatacacactattagtggtttcttttgtgaaaagagagagaaaagtctcatttattgagcaatggatacataaatcgtgtcacctcctttctcgttgagtagcattgaattaatggaataggccaagagcagatcaggaactaacttgtcccttcagcggttgcaactacacatggctacctaattaataaggccgtcgcgtctctgtctctttctcttactattccagctctttcggtggtagttggtgctggaattagtcaaacctgcatttgtaatttggaatgtgagattccaacaatgtttattgtaatattgaattaaatcaagccatttttttattatgagctggatttttcttggtctaacctagtccttgatgtgtcgtggactagtcaattttttaatatataaaaataaaaattatcaaaataaattaacttctatatataaaagaagttaatgagatatatataattataaagagttcaagatcaattttaaaagagacaacaaggaaaaaaagtaattaaaatccaatctcatttacgttgggctcaagaaacttacaaggaatccacccattttttttattaaaaaaaaaaaaacttatatatagttataagtaaaacacatgttgagttattaattactttttaatttaaataatatacacaaattaataagcaacacgaatgaaaaatctataagatatttaaaaaatacaaaagtttaaaatttttctttctcaagagagttatagaaaatataaggttgacttgataatagagataaaagaagaaagagataggtcataaattcaaatcctcgatctactaataaaaattaataaattaaaaaaatataatatctaattacaaatagttgccgagttttctgatatatcatgaacttgaaattaacaagaaaaaactcttgtcacgtgaaagttttatagaaggatatgaaaatgtggtgattgcggtatcgtgcagctactaccagatatgtagttaaaagaaatccaatcgaaaagaactgcttttactagattttgtcggtagatgatatatgcttcaaatttaataatatacgaatttggttgaatgtaattcatcaatatccacaagatcagttcatgcaatggaagcagtacaacttgaactcacgaacttatttatggttttgcacggtgagtcatatatatatgttcagctttacaccaattcagaatgactctcctttgcaagaaggtactccctctttctgacaagctaggtgtgacacaatctagaaggatggccacaaagaagaaaaaattaataaattttgatatatatgacaaataattcagtttaatcctcttctccttggaccttgggggatagtttttgaagacattaactattatttcttgatttaggcaatgttttatcacgctaaatgttggacgttcgggaccataaaaatgtataatactcattgcgacatccataatattcttcttaaacgatctatatagtactttgtattccaagaatgtttttcattacactaagatcttctatgacaaatatttgctcaatgttttgttgagaacaagtgacttcatttttagtatgatcatggactcaccatttttatagattttcacaaaagtagtggcttgcgaaagtcttctaaaaattatgttagaccataaaaagctcgaaatttttgtaccattattttagagcttgcttcatatataccataaaagttttacttcaaataacacactaaaggctcaaggtctgatactatgaaaccttcaagttgctctatatataaagataaatatagtgtcttaattaaaattttgggataaatacttatatataatttacttgtgccccgatctagatcttcaaatattttagctctatcgatcatacttctctaacaaattgtgacatgtatattgtatgtaagtgaactctttgtaaattttgtacgtttggtggttatcctcgtgcatctagtttaggtagtacaattatcccctatccagcctccagcaggctggcacttctgttctattctttgcggattttaagactttttcgtgtgaattgaacgtaagtcttgtacatggtgtcatgagagaaatataaatacattgtagggtctagcagaaatttgtaagatctcatttaatatgtttgtatttatttttccactcacatgaattcatcacgtaaaatcccctattataagatttaatttatgatatacattgcacaagtccatcttttctcaggggtcgacattcacatgacacgcgtcatatttaggattggttggtatttagcttttttttcttaatttatttgttaatgtctattattaaattatattatgtattattttcgcctgttttttatttattttaagaatttactttctaaaaaaaatattctcaatttcttgtataaatttttaaatgaaaaaaaaagtaattttttgtttatcataaaaagtctagataaattgaatcttgataatttatcagaatcaaaataggtcttaagattcaataaatacttagaagatagttataaattatttatcaataaaaattttactgagaaaaatatattatttatcaactggaataacctttattgaaaaaatattttcttttatgttatacattcaaaaaaagaaatgtaaacaaccatttaccccactttgaatgctcgtcccatccatagaactgtgatattgtcttggcaattatggtttccaacaacttcttcacccaaacaccaaaagatcaaagttccattaatagtcctaaccaatatttattttctcacaagttcacttccctagcacactccaaattcaccctacaacaacgacacacacacccctcacacaataatggaagaagggcaaagaaaaacaacactacttctatgctcccacattgtggttcttcttttactctccctagtggccgagactagtgccaaggtttcagcggtgatcgtcttcggcgactcctccgtcgacgccggcaacaacaacttcatccccaccattgcacggagcaattttcagccatatgggcgtgactttgaaggtggaatagccactggaaggttttgcaatgggagaataccaacggattttatatcagagtcttttgggctgaaaccttatgtgccagcatacttggatcctaagtataatatttcagattttgcaagcggggtcacttttgcttctgcagcaactggttatgataatgcaacctcagatgtgctggtaattcatgtcttcttcaagctatatatataatggaactatatatgcatgctttactttttcaataatatctctattttttttttcttggctgatatattgccagtcttactatttttgaaagaaaaaaaaaaatctatacactccattttccttaaaatgttagtcatatctttcatttttctttatatatatatatatatatatatatatatgtatgtatcacataatatcatctttcatatttatgtttttttctctgtcagtaaaatgatctttagatctctatttagaaaataatattttgtttgctttcaataaatgagcaaaacatagacacatatagttttttttaagagacatataaaattaattcaaattacttatttttttcccttgttttgcttcaaaggaaaaggaaaagaaaaggaaaaggaaaagaaagagagatagataaaaaaaattaaatttaaatttaacataaagaaacttttagtttttttggagatcaactttgtttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagataagaagatatattttacatgataaaagtataattataattattaattaaataataataataattaaatttatgactaaatacatataattaatgtaaattatttaaatttaagaatgaattctaataaaaagtaattttgagcaaaattaatctaaaaaaatgtcactttgaaaagaatatatttaaatttgatatacaaggctgtacatatgtagggttacatcacattattttttctaaatcatttcagctatctccgcactgctacttcctctttgcctctcctctgtttcttttctcttctctgtcaaacaaatagaaaaactaaaatctcctctttatttttttcattattttttttttgttaaaatctgaaatttaaaaatgaagcttatgagtccattgtccaagaataattatgcaaaccataatattggttgcagtctgtgataccactatggaagcaattagagtactacaagggataccaaaagaatttgagtgcatatcttggtgaaagcaaggcaaaggagaccatagctgaagcattacacctcatgagtcttggaacaaatgacttcctagagaactactacaccatgcctggtagagcatctcaatacacaccccaacagtaccaaatttttctggctggcatagctgagaacttcataaggagcctctatggtcttggtgctaggaagatttccctaggagggttacctcccatgggatgcttgccacttgaaagaaccacaaatattgttggtgggaatgactgtgttgccagatacaataacatagcattggagttcaacgataggctcaagaatttgaccattaagctaaaccaagagctccctggactcaaattggtgttttctaatccttattacattatgttgagtatcataaaaagacctcaactttatggtatgttatcctaaaccatgcatatatgtttttcagatatcattgtctctttcccccttttctgtttcagataatttggaccctcctcccaaataaaatattaaaaaaaatcactattcccccttacaattttccactgtttcgttcttgattttatatattgtttctatctttagtaacaacaatgataaaatcaataatatatagaataaattaaatatgcattgacaatctaaattttttatattgtcaatgtataataaatttgttgatttttaaataattatcttaaaatttataccaacaatttctaattagttaatgtacccatctcttaatattttatataaattaatcatgatgtgcactaattcattatttttttttctcttcaggatttgaatcgacctcagtggcatgttgtgctactggaatgtttgagatgggttatgcatgcagcaggggccgaatgttcagttgcacagatgcttcaaaatatgtgttttgggactctttccatccaactgagatgacaaatagtatcgttgcaaagtacgtggtgctgcgtgttttatatcaattcttacaataaacaaataactactagtgaaattttatttatgtactggtatctcttcatgtttgcacattcgccataaagtgccattcgggctttctatgaatgactgcatgtcgatgtgtacatatataaaaatatcaatacagcacattcaccatataatgtgctgataattagaaataagtcgttttgtttagaacaatatatatagtatttatattttttaggcactttactagagtcggtgtcctccatgtatgttttccttcacatatatatatgtcctattatgttgggtctatagtttgtaatatctatccatggtttggaaatgtcaaatcccaaaagggagaattttctgatttttctttggttgcaattatttatgggcaaaatcaaatacctacttcattgccaaattcacttttcagaaattatctaaacctaattaatcaatttaccataaatccactagagtcgaccaagtggtttgaagttgaaatagaatgaatgagatcataagttcaaatcttagtgcaactacaactatacaccaaaaaagtcaatttaacatgaacttattcaaattaataaattcatccaaactccgtttcacaaattagctgaatgataacaccatattaactctttattaatcattatcagtatcttaataattagacaccatttctagggcatctaccgcttttgaaatgtaaatgttctttaaaaaccaaaacggtacatgaacatttcctcaaagtcacaatcacttgtaaattgtaattgtcaagtttattttgatgtcatgaaacttctgacttttgagaaactacattagtacaaccaacacctaactatgaaactaataaagccaatttgtgcactttcataagtcagtcatattcatgcttgaacaacatgccaaaactagataattccaacatataggaaaaaatccaagtcccacatcgactaaagataattttatttataatatccttctgattgttcattgcaacttcagcgtcaacattagctgtgtttgtaagcatactcttgctagttcgaacctcagaacactagtagctttacctcttgttgaccagatattatgatctgtagaagttttctccattggttttacatatcagatattgtaggcaaatatgatgttttagttccaaaaggatcactttggattccaatagtttactcttttgatgggctcttcctttcttcctcgcaacataaagaaaccatgtcttccaggcaaggtaccaagggaatctcctatttcagagttagttttacattctcatcaaggaataaagcactggcaccaaaatttaagagagctgatattaaaatttatcttaatccatcccagtagaggaatcacccatctaactaggcaaggagcatgttctagagttgagtctatagagaagacaaatacacaagttacttccatttggatgaagctccaaaattctaaacaccatctcctagttatgattctcattgttacagactttggagttcttgttttctctaaatcaaccaaactgtagagaggtcaactgagtagtctttccttgaaaaaagccatattatccagatgttatccagattatcctccagtgttgttctggttaaatcccaactgtctatacttccagcgccccctaagtcctacaagcaatggacagtgttttcagaacagtgatgtaggacatgatgcagatgtagcaagaccccaggtcattcattggtagcgctgcatgacaaaccagccagataaggtgttaacaaattttctggaattttaaagctccaaatccaactcaatataaaagtgcatagagttccatgtgtgtgcatgtgcaactgttgaaatttataataaaaatatggtatttcaaaattactgataagtggtatgcatacagtttacaatcaggtttagaggcaaatgattgaaagggaaattcaataaaatagacctaagttgtttcaattattacaaatcttacaatagcaaaaagaacattttggcaagccttgaggcttaaaatagaagcatgttatatgaaacattctaatcaattaaaataacaataagagattaataagtaaactaactattaaaaatattcaaaattataacatagaacatggccacagaagtaaaacaaaacgtaacatctatctcacccaaaaatatgaacagagcaacatagcatagaacataagccaaatttttttcaaggtaatgaggttttcaacaaaatcctaatcaaaagcattgattgcttgcaggataccatttgattaaagtcaagaaacgataaaaagaaatgcatgatagaaaaacaggataatacaatgtgtgaaaacatgggaggatctgagtagaagaagtaaactgaacaaaggtaaaaaatgaataccttaaatggagctattagttcttatctttatttgataacctttttaaacccttccagatggctggaccttgaggatgcacattcacaaagtactttacaaagcgtttatcattggatgcaattatggtactcatggttaatgtaggatttactgcattcctctcctttagccacgcatacattgaaagtctttcaacaattttgtccaaatcatggcaaaagtatgttgggaatcccacgagatattctagagggtaatctaaaacatttcttaagaaatcaatcttcttttgaattacagctttgttctggcttagaatcataggagctcgttttatcatttcaatcacactgttatagtccaaaccagcttctaccaggcaatcaaatctctcttgtaattgatcacctctccctcgaaacatttttaacgctttggccatctcttcagagttctctgtgtatcccaatttcagcaagaaagttgtcttttccaaataattacgtgggtcatgactatctacctttccattgcccttctgctcctgttttgatgccaaactaattagcttcaatggatcatcctttatgatttggcacaaatcagcttttccaacttttaactcctgacaaacagttttatgacctttaaaggaacgtgtaatcaggagatgcatgtacttagacaaaatgtgtgtaatgtcatcttttcccattccaatagcacacaaaaagtctatcactctcaacatatctttcgcacacttattcaacaagatattgggatactctacaaaataagaataaatcacattcatctcaacaccaactttaagcaatctaccaaaaactaagtacactttcctcccaaaaccctccaacaacaacttaggattttccctaaacaaattgtgcatttgttcctcggaataacccactttatgaagaaacagcatggcatcaagcattcttttccaagtatatgtccttgaacaagacaagtaattcaccatccattcactctcaatcccaattctcttcaaccaatcaagcacagaaacaaattcaaaattcacatcaccaaccaaaagcaaagggcaacaaacaacaagcttgacaacagttgatttactcaaacccaaattctcataagcttctaactttgacaacaccaccccactagcacacccaaaaatctcttttgcctctttaaaaaacttccccattcgattccttggcaccccatagttacacaaagcatgaaaattttcaagcagcacatgatcatccgccaggaaaaacatgccatgcggaagaaacaaatacaactcagaagggtcaattcccaaactctcgaaaaacggttcaaactcgttaatggggttgtacctgaggaatcttttcaacgatcgaagaacatcatctttgtcgtcaatcattgagaccaatgattcaataaaacgtggtgagttcttgctgatgtactcggcgtcggagaaagtgtagccccgcgtggaatgcatgtaatccattagagcgtgttgagcttcggacctcaagaggcgagagacacgtttgggggaacgtgacgagagaacggaacttaacggagaagaagagggaagagggatgggttcagaagcgcgaaagcatcgaactttgagagaaatggaagatgggtttttttgtgaaaggggttttggaagcatggcgtggtgggaaaaatagaagccatttaaattcaactgggaaatcattggagagagataataaaagaatgaagaagactgcaagtgtatataagcatgaaatgaaattagggcgttcggccaaattcggtttggtaggagtccaatgtaattttgtgttttaaaacaaattataaaatatatttttccttcatcctatttagtctcttttttttcttgtaacttttttttttagtttttataaatgtatttgttttttcatctataaaatgctttggataaagttttgagtgttttgatatctaaaccattttaaggataaaaaaacaaaataaacatatttagaatgtttaaaacaaaaaaaatactaaattataagaatgagaaaaatattataaaaaaatggcaatgcattatgcatttcatcacagtgctccaggtttttgctaactcttcttaaaatattatgtccagttttgttcctaagaaaaaaactgcacacattgattttatgacattgccttctatacttcactgaatgttaccatgtaataagatgcttgaacacatcatacaaaatacttgaagcatgtgatgcagtgtgtccctcaaaagttaagaggacctaacttcaacattggcagaatggaagcttgaatcagaagatcatgatataggaaaggaaagatacaagggcaatatcaattaagtacgtgttaagcatctgaatagaatgggaaagagaagcaaaagcttggaggtttcgtaatgagatgcaatgtataatgaggagaaacatgaagtgcatgtttggttgtagtttaaaatgtagcggcgcagtgttgaaaatgagatagtataatgttttattattcactactaactactaatgtattgatgtattatgtataaaaaaaatgtattgaagttcgtttggatgtagttcaaaagatgttctagtatcttatctactataaaaatgtattttttattttttaagagtgtctagttattattttttcaactttttggaaatagttacttttcgagaacgtgttctataaattatgcttgaataataatgttttaaaaaaatttcaaaatgacaaaatatgccctccatattttctaaatcctcagcatgtaagtcttggtttctctctcttcttctcataagttttgcgtcttcctcattcctcaaactcttttttgttttttaatttctcttcatatcatcttcttcatctcttcttcttcgattgctaacataacatgttaacaattttttcattaatttatttttcttctcgttaaattttgaattattatggattaggattatgattttgtttttctcattaattattatgaattttgaccccctgaacatattcttgtggggattgcgaggtgttccctaaatattcttaaatgtttatcattgtttttagttcttaaacttgtgaaatgtctctcaatcaagttcttgtgaaaagaaagaaagcagaatgatatgataaaaatattgagattatgctaaaagtgtgcatagaagaattgaatgctagaaataaacctcacaactacttcactaagcttggttggacaaatattgcataaaagtttaataaagcaacaaatttgatatataaatataaacaattcagaaaataggcgggattctttaaaaaaggaatgagaattatagactaaatttattgggaaggacattggtctggaagctaaaatttagttgtatattgaatctatagtaatttctttatgaaattatttttttagcatctttagaaaatgataggtatgtcttaggaccttggaccaggcttgttgtttatcaactcccaaacttttggtattgaagccaattgtgcttcttctgtattttctctttaatgaattatgctataattttttatgatatacagtgcttctgaatttaataattggaaagcaatattgtatttcatcatacaccttacaattatacaacttcgggaaatttctaaatgcctttgccaattgcattgttataaataattatttgttagaagttgccagcatctcttggtataagtatttttctttgaaaaagaaaattcttgaacgactggtttgatttaatttattgtggtcgtttatatttaatttgtaggtcttgctatgtaatgccttaaaagacattcttttttatcgggaaagataatatatttatatacataaataaaatgtagagacaaaacattaggtacttacacagatacatcacccttgccagagatttcataaccacgtcccatctatgtgcatgagcaaatggaaatacaacacggttgcaatatattaatgatgctggaacattaatagaaaacaaccacatataaatgttctattccagtacccacacgcacagataaaaaaatgcccaccaataaaaactctttgtttaaatactatacactacttgctctagacataaatctttgcattattaatagatatttcatatttctagctatgccataattgcagactgtgataagaagaacctgtcaccatgcaggaaaataaaaacgaaaacttcatcaccaattgaccttccacaagatctggtcttcattcataatcctccaaaatacaggtccctgtgttcagtgccattgtgcaaaagaaacagagaagcctctttccaatccctttatccactgccatgagtgatacagtgcttgatagacaatttcctctaaatatgatattgttcctattgctttttggaatacactagtgacattttgtaaattttattctagccagaagcaatatacaaaagggtcaattctgaacttatttaaggcacatctattgctttttgggcttatcttgaaatgctgctccactaaccggcccgggttgggtcataaagagtcacgcaaaactaaaaccaaaagtccatccagtcgaaacgttcccatctcgccaccgtgaacacccccacacattaacacactccaaacgcacgttagcaacctccgccgtcttcgccaccgcgcgatcgccgtcgatggagtctctcttcgactcgatcaacgtccgcgaccttctttcggcgcaggacctttcggaccctaactcccctctctcggcgccggatctccgtctcctgatccagcgcctggagtcgcagtccctccagatccgctctcaggtgcagtcttacctcgtctcgcaccgcgacgatttcgcgcgcctcttctccctctgcaacgacgccgtttcacagacgcgcgaggtctccgacgacgtcgccgccatcctccgactcctatccgaccgcccgatcgacgccgaggtgcgcgacgtcgtatcggagataaaggcgaagaaggaggaactgaaagtgaagaaggaactgctgggattggttggaaccgttgtggcgctgaaccagagattggacagtgtgagggaagcgttgaagagtgggaggttcgaattcgcggcgcaagggttgaaggagttgaaggtggcgttgaggattggtgaggagaatgatagggagcctttggtgtatggcttgttgaggaaggagtggtctcagtactttgacgaggtgatactctgctctcttgttgctgttttttatggtttcgtttggtgcattaggtttatagttatgtgttaatgcgtggtggatttggtgctgttaatgtatttgtgtgtgtgccaattgaattgaagcctttcagaatgtgaaactgaaataggttttggtatgtggtgatttcaattgcattgacaatctgagtatgaaaggaatggaaatcagggttgatgtatgacaatgtgcgataaacaaatagtcaaatacaagatttcatggctctgtgcattattgttctttccatatttcccccaaataaaggccacgtactcagttgtatggaaacaaaatgctagtatccctgtggttaccattggcctaggaatccatttatgaagtttgaattcagccaagtttatgttacttggactattgtcaactaaacataatgatgataataatagttatataatgatgtctatggtgatgatatactgtgtaggggacacttaacgcgtttttttggttgaattatattttcattgatatatttgacaatataatcaattcatgtgatttgtgccatggtactgatggttgtatagtttgtgatttttagagtttgtgattgtttttagaggaattcgatttgggtttgtagattcaagaggtcctcatgaagtttatggaaaaagcagtacgatttgatggggatttgaatcaagttgaagtcaagtatcatttagaagttgagaatgtgaatgggattcaattacaaacagttgtggaggcaatggatgtaagttaattcattatattttatgctctctatttggaacactctattctattcctcttgtgctgttgtaaggttagaaattgatgagctccattgaatttatttgttcttcctctaatttatgtcattttttaggtagttggtattctagagtatgggcttgctaaagttgctgatttgatgatcaagtatgtcattactccttttgtaaatcatggacaacctctttcatttcttgaggaattgcatcaagaatcggctgtactgaagatagttccatcaccagatagtaaggtgagtatgatatgttaggctcatagaatcaattgtattgctcatgctttgccattttatgacagagacacccgcctgcacctttggcggggaagggtgttgcttgcttgtgttattgatttattcatgaacagagttctcaattttctagtttagatttttttaataaattaggaagcattgtcatttaactgctatgttatttctaaatatctgattttcattttgcagtttgaacatttggatggagagtttctctattcagggattctgctgtttatcaaatttatttacagaagtatttgcttccagaaaagttcttggatgcagtgttttggacggttgacatggccaaggatatcagagctaataatatctagctttctttcaaaggtttgctcttcagccatatgccattagaaacttgattgaacgaagaccatatccatgcatcctgtgctttgaaacaactctaaggatgtgtatctataaaaataccatttcattgatttcaattgatattggatcgaatgctattgttgccttataatatgcaagtgcatatgaattctaccatccctaccaacaaaaataagattattccaaatcttgtctatcttatgatctagaacaattatttagtggttagttatagtgtctgaaagccagagaggaagtgttgtgcgtatttgataatttgcagatagtcacttgagatgtctgatttcaggttgtcccaacagatgcatcaaaacttactgactttcggaagatcattgtatgttcatctgaatttgaaacggctttaaaagagcttatgtacatttcagcatcagatgacaaagataacaggctgagcaattttgctgaaaatgttgaggttcactttgctttcaagaaaaagacagagatcttggctaaagctagaaacctgcttctagaatgtgatttttcaattcctcaagtgagtttccagactgggaaaactcttcttttgctattgtgatctgtaattatttatgaagaatgtcactgcaggagtatacgagggatggtgctgtttggaagagtgatgaaacatctgtccagtcatccagccatgtggtagatttgcttttcttatcagagaggtgtctagtatccaaagcagccaaacaattgatggagctagttcatcagacactgcaggtataccatccagaataatgaaaatattttactaatgactctatgcagcacattttatttgaaataaaactctggactatctaaatactgtttcaatcagtagatatatgctagtttttaccaggtctatcatgatcgagttatttcctatagaggtcattctcattacggcctgtaacaattgctgtacagctgataaattgaaagaaaagtatacaaaatgataaactccggctccccagttagttgtaactaacatgttttagaatagttagaagagggatctagaattggtcccgctgaaagcacctgtaaattgtatatagttaagggtgatgatggaatattatcataacaattagatatcagccgaaagtctctaaccagatactttagtcagaggttcatagtattcttccagtagctcaaaactagggccccgctaacaatattattcacctcatatctattaacctgcaatgatgtcatctttcaatatagggattagacagttgatgacaaagtgtattctttgtttttcttttcttttactaatactgtaatgataattgtttgattattgaaccatattaatactcttaatttaattaacatccatttaagtattttcagtttattgacctacaagaattttaatattaatagtgaagctgatcattgcaaatgaaaatttgtccaggatgtttgcctgtcatctacaagagttgctttggaattttatcacacagctagagatgctatactactttatgaagtagttgtccctgtcaaggttagtccatgtaaagcagtggccctacttagtatttctatcattatggattgattttatggggtgaatttaatacagtaatgcaagagtatggtcaatatcattattaattctagaatgatgtcctttgtgctaatatttaatacctttcctgatctttggctgagattacctattaactactataaatgacatccaatacatatggaggatttatcttctttatgatgttgttaacttgttgcatatgtcaggttaccactgtatttgggtgttagttgttgtctgtgtatactttcagcttatagtaataacttctgtttttgatttgtgaagctagagaggcagctcaatggcattaatcaagtagccgttctgttgcataatgactgtctttatctctcccaggagattcttgggtttgcatttgaggtatacatacttgaataactgaggatgaagtaaattcacaatatttaaataatttactattctttaagttttaaccaaaaataagttttttttttttaaaaaattctgatgtcatccttaacacattttattttaatgttagtttgtttttgtagtatttgattaaaacattactggggcccattcctcaaatgaaaaagtcaaggaaaacattcaatgtaaaccttgtttattttatgttagtattttttttttcttggctcatgcattatgctcttttctcagtatcgaacagactttccaagttccatgaaggaacatgctgtgtttgttgatttggctccaaggtttcagctgttagcagaagaaatattgcagagacaagttcaccttgttatttataatttgaaggaggtactttctttattaaaatgcttgaagcatctagcgatatcttactaatagttgacatttgccttactgacctgcactttcccacatgtgcccatgtttataggctatagatggtgctgatggatttcagaatactcatcagatgaaacaatttgagtcagctaaatttagcatagaccaggtaattttcttgtctgtataatatgtctacaataaattaccattttctatcccgtatttttttatgccttatttcctttattcctttttttttctctctgtatccaacccacagggtgggggagatttattacataggttactagtattagttgatgtatttttagtttcacaaatgacatgactgagtgtacttgattaggttgttttcattctggaaaaagtacatatcatatgggagccgcttttgctgccttcaacttacaggagaagcatgtgtacagtcttagagtcagttttctcaagaattgctagagatatacttctgttagatgacatagctgcagaggagactttacaggtagaatgtataccataagtcaactaattaatgcttgtagttgcaccattgtatttcattagttggtcttaagcattattcctctcatattttcagctacaaagacttatttatttaatgctggaaaacctgtcttcattatttgagtctttggcccctggagaacagaatttgcatgagttccctgcagagtctcttgaagattttatcccatccttacgtaaaatccgtaaactatcaggcatgcagtggcatcttcttaattatttctttaaaagatgttggttggattatcgttgactcatccatgacaactaatctcttcatctttcatttgcctcagaattattagatatgcctttaaaatccattacagcatcttgggagaataaagaattgctctcttgtggctttacaataacggaggtattatttgattattgatgactttgtttcatgaccttcttgggacaatatttttttttccttcatttatgttaattatttttaaacactgcccttggattgttattttatgtcagcttcaattagacagtgtcctaaaatgacttaatatatattatatctctcttgggcaaacacattatgtagattcttcaatctgactctctttctgattattctttacaacgttgtaatttgtttggacaaggctcctctaaagagcttatctttatttaatttaaagtgaaacacaatttaacttagtaaaattaaaggataaatacacccttgcttactttagagacattctcattttagaggagctttatcccatttgtttcacccagagtttcactgtatattcatgtgatgggactcattattacactaattctttcttcattttcctttagtggatgtttttccccttctgtttctagttcaaatactcctattttaaaaagaagaggggggggggggggggtnnnnnnnnnnnnnnnnnnnnnnnnnnnnnnnnttattagatttgattgaccagtatgttttgttctataaaaaatgattttaaatgccctgatctgatatcttttcctttactgtcttcttcatgttttgcaattttaaaaatattgtattagaactgtatctgatgagctttttcttcacaagcattctcacttgttatgtttcttacacgtctgattgttgaccttttttgcaggtggaagatttcataaaagctatatttacagactcacctttaagaaaagattgtttatggaggatacaaaatccgagcttttagaattcatctaacttcctactaaatttataaatcacgaagaacacactggagtttgagagtcagagatgatcgatcacctaggcaaatatcatgtgagtttgagctgctgctccaaatattacagctagcagaaagtacagattcgaagcagattcgtgctgacgaattttctgatgaggaggcttcgccataaagattttgtcgacaagtcttatgctgaagaagtaatagtctttttttctccttccttttccgtttaaagcaaaactggggaggggtttggtgcagagttgtgcctcgtttccattatagagcatcctaattgttgctcattaacaggaaacacggatatgaattcaatggtagatatatacttgtaatgctgctactacaaggcagatttagtgagaccatttttagatgctgatagataaacgattgtggcacaaatgttggaaatagcatttttcattcaggtgttgtgattcgcattattacgttataaatgctacatttggttgcagtgtacaaattgcctacattacagttacgccactattggatgtatcgaccttatgtaatagaaataatttgttgattatatttaaatttaatccagtggtctataaaatgtcgagtttgtgttacaagacttaggaagacatcataacctagggatggaggtttatcaaagacaaatgtttcggttagcttaaaagttaaaagctacatctaaccaagacaattagtagttgacaaataacattgcttaacgaactaaaatcttaattctaatcataaattaagttagttttaatctaaattaacgaaataataaataattttgaattaatatgaaatattgtatgtgatttatgtaaaaggaattttcaatttaatttaatgatgagttttaaaaaaaatgttattcaattaaaaattataaaatattataatagttattaaagttatgtaatataatctcttctgaaatttaaatatattttcaatagagatgcaaaggaaatcccttttagagttgtttacaattcgataaaatttgaaaaatcaatccaaaaaattgaaccaaccaaaaaacctcaaacaaaagttgaaaatattattttttactgattggatcaaatttcagatttagtttttaaaaaaatcaatctaaattgaacttaaaagtgtatatacttttatttgtaaattttagtatgactcatttacatttttgtttcttatatattaataacttaattattaaacgcatatatatatatatatatatatatatatataattaaatataactttttaataactatttgaataaaaatatataaatataattatcaaaannnnnnnnnnnnnnnnnnnnnnnnnnnnnctactattaaatatataatgacttattgatgcaatattttaacattttaatattttttattatgtttgtatcatgttttaccacttattatatattaccaatcaatccaaaataattcaacccaaatcactttaaattagatttgattgaatcaaatttaaattttaaactaatcataatttctctttaaaatccatccaatccaatctaattttcactggacaaggagctacaatccactagagatttaggtcataatggcatcatcaccctacgtatcaataactaatgatttatacaaaaggtagatcaaaaagttcctttgtcatgaaggttgaacctgttagctgaatgctcattgatagggaaaaagaaaataccaaaacatgctaacattttccggagatatatcagtagccactgaatgacatatatcaaaatcctcagagaagatctcactcattactagactggtcttttaacttggaacatggaaaaacagaacagtgatcacaataatcatgagaaacaagttgcctgtaacttaaaaatcggtggttgaaactttaatttggcataaattccttataaactgatcatagctcatccttgcttgaagcatcttcccccattagttcttcaagagaaaattcatcctcctcaattatttctccatcttttccatcccatggttctgtctttacaatggttggagtgccttgcaggggcaaattccctttgcctccacgtccagcttctttcacaaattctctgaagaaaataaataggtaatatttaagcatttgtttatctcaataatgtgtttagcatttagcataaagttagaagaacaaacttacataatctggtcaagttcaaaagcactcttgagaggagcataaacagctttcttaaggttaagggctactaaagctggataaccataccctccaacacccacaatcttctcaagatctggctgcttccctgcagctacccagacgtagctgtccacgacacaaaaattcaattaatattaagaatttgtcaacaaagactaattaaaatatgcatatataaagcatttgcaacattgatagaatcaaaaaatttagaaatgatgacattaactagcagagtgatattaaggtgtggtgtggaatctaagcgaaaagtacttttatacttgcctgtatggattccttttaaacttctctgcaacagatagtaactgctgaagatatatgtttctcccctcagccttggaatctaaaatgtcaggaaggaaggcaacaaaacagattgcggcagaaccacatttctcttccaaaacatcctatagagaaggttcatgttaattatcttaggcaaagcacaggttaaggaaacgaaataggaagtatttattaaaaaataaagcatttattgtatcaaaaacaaaaatcagttaatacttttttttttgaataatcgaaatcatttaatatataatcagtgcgcttagggaactatcatcattcgttatcttgtattcctctctttcaaaccaatgcacaaccaaataggtaggtaggagagaaaatgcttactggactgtgtagctctgtcacttctggaggagcaacgtttgtttccagctgctctaatgcaaatgattcaatagccaaggcagttcttgcgccttcataaggaataggactatctttatcagcaccaaacaccaagattgttgggaatccttgaactttgaacctgctcattagagactgataacaaatatcctgtcagaataatataaacaaaaaagcataataaaaaaacattaataatgaacctgctcattaccttttcagcatcacagtcaacatggcccagtttaaccttccctttcaaattattggatgctttcttccactcaggagctaattttttacaatgtccacacctttgggaaataaaagagaatgaaagttattagagcgacaaatctgtaggaatactttaggttcagtcaggtaatcatgatatcaaaaattagattttggaacacaggaaacttaccaaggtgcgaaaaattccacaatccagagttctttgcttttgatcaccaattcatcaaagttgccagagttcaattctactgaagaactggtttctgtcttttcactagatcctcctgttgcttttccacttaaccgatccttcaaaagagcctttacctatacatgcagataattaatgtataaggaggcaatattttggagtaatggtattacattttactatttttttaaaaagcatattagaaacatgggagaaggacttagcagtgagtaacaaatcacaaaaattaattggtgaattacgatgtgatagtctgcccatttagatttttatttattattctgataaaaagttttccattgggcaacaacatatcaaacatcagttaatcaaaataaaccatgaattataacacaactgaatgcgagtgatttttttttttttttgattatttatatagacctgtattaacaagtagtcacacaatgctcaaaccctaatcccaatacatccaaatcctcactctgcttagattttctacactaccaagtgatgtttaaaaagaatttccctttcaaatttttaataagaatcttgtttactttgtagtcattaaagttttcatagaaatacaagaaattgttttgtttgttacaaaaagaggacatctatctactctatccaaagtccaacatcacacatgcaataacacttctcataaaacatcagatatattccaccacgtttggggcaaaaaggttataaaaaaaaccacatgagatcccaacaaacctgttgaagtgcaaattcagcaattggtttgacatctcttgctccttggtaatcaacaggtggctttccaggtgcaaacacttttattgttggaaatcctctaattccatattcctgtagagtagggaatcaagaaaaagttacacacacaaacacatgcgaaaatctaaatgtttttgaaacttccagattccaatataaattatgatgacaattgaagaaaacagccaataactgaaaacacctacaaggagtaaatgagcctcatgcaaatatgcagatgttatgaagaaagagaaaaagaatgtccaaagagatattctatcttgtacatgtaatatattctttggttgctttacatacacagtgggggctagatacgaaaactttacacatacaatattcttgcatgtagatattccatacaacaaacacgttaaccaaaatggctgaggtgattagatccaattaatcatattccaattatttgaaacagttcctagagctcaaatgattatgaataacaaagccgtgttttgcataatgcttgatccacaaaaaaggtatttccagtgtacattatacacaaaagttaagcatataataaagcgtcttcgtaattcagaaaaagctgactgcaagaaccaaagaacatatacagcatagtcttcattcaacagatttcaacatttaattatacataaaaatgccataattaaatgaagaaatgaacaatagacaacctgagccaaagacgggtgagcatcagcatcaattgccgccacagtaacaacacccttcaacacagtagctgccttctcccatataggagtcagagcttgacagtgtccacaccatggagcaaaaaattcaacaagaacaactccatttgaattcagaacctgcgaagaaccttgatatcagtcatcaaaactacaaccacaaaatatcaaacttggcatttacatgcccagatggatttcaagagcaaagatgggaaatttaacgtttatacgcaacaaacatttgaaaaaatggcaaaaacagtgagatcacgaaatggggtaatggagaaagggttaaaaaattaaacttgattcaccttggacttgaagttagagggagtgagttgaagcacgggtgaggatgctccatagagtgcgtatgaaggggcgaggttgaagatgaataacaaaagggaaaaagaaacgagaaatggggttcgaaattgagacttcgtcattgtctttctctcacgctttgcactctgaatctccccgcagctaagaaaaaacccttggtttttctgttcgaggacttgctattgctacgtgtgtcatccaatcatatatttacacgtcagactcccactttggcaaatgaaatttcttttttttacataattgaaagttaaaataaagaatttgattaatgttaaaaataaaaataaaaaattcttacctttgattcaatctttgcatgatattagtaaaaaggaagcatattaccatggaaagtttttaaagccatgggcattttttttttatctgcatagaaagaatattttacatgaaaaatacattagtatttgcatgaagaataatgtttaaattagagtaaaaacattaatatcttacatataaccttattgatatacttaaatgataaaataaaaatgtattgtactcggaaaaacatttttatatgaaagtacatttatagtctttataaaaaaactatccatataaaaacttattaagatttatagatctattttctatagatgtactttttaagaatataaaaacttattaacttgattctgttttttttatatatacaaacatatcaatatgtaaattattatagatgtttattttaatagaaatttcacataatttttttcctaatatataatacttataaacattttttatatgtgcacaataaagacatataaatgttcccacaggtcaataaactagtttagtttaaaaagtaattactctttaacactttttgtctatataagatatatcaatagttgaagaataataaataatctacttatttttcatcacataaattaagtaacatgaaacatacccatgttctgtgtttctaagaacttctccatagtattaatattgccttgagtgtatgataaaccctatatagaaatgcatatatctgccattacctataatgtgttacttattgagggagaagcgttggggttgctcaaagctcttacttggatgacagatatcagccttactcatcttattttggagtgaaattgcaaaatagttgaagataaaattaacagttttgcaacagaagatacagagataggagatattattgctgagtgtaaaaacatacttgtgcagaatccaaggaatggactttgtaaagagacacgcaaatattgttgcacacttgcttgcaaggagagcaacatatcacgctaggctcaaagattttcattatatcccttctcgtatcatgaatgaaatgtcttaattccgttcttgtaaaaacaattagaatgtgttacgtttatattaattgttgcgaactagagtcagagaccaaactgttagaacttagaaggtaaagaggcatataaatccaccttttgatccattccaggcatcatctaactttcatcattcgttcgggatacctccagatcaaaacactgattccactacgtaagttactaagtatgacagactgtcacttcaaattcgaatgtgcaagatgcatctccatctccatgtattttattagatcgtttacttgtaacttgtgaagtacaaccatggcatcaactccaataagtaaaccattggaatagaccacattccaacttagattacacaaccttgaaccttgggtccatcatttgttggaatttttgtttcacgtctttcttactagttgtctgaatagattcaagtaaaccattataacactcgttctattttccaccttagagacaagtcccacatccactagtttcttatataagtcattctttataaacctctaacatgggagtcagtttgccgagctgagtaacgttagcttgtaacctaagtaggggccctaaagtgatgggacatggctcgggctatgctcggtcgggttggtagatgcataatgctggcctgcccgctccaagttaagagatgagtcatgggacttgggcgaaggctcaggtgtcctgactcctaaactggagggcatagcgtgaggctggtttaacagagcagcgatcacctccggctcctgacagtggggggataacaggctgcagcaattccaacccaccatgactgggtgtaccaagctcctgaaccatcatttttttttttttgtaatgaatcaagtgatacctttagcagtttaccttcccaagagaagcccttttgaataatcatcctagaaccagacgtttctacaaacctccaatcaagcttgcaaatcaaatttgtcatcagagttatgaaaagaaagagcatccattaatgaagtaacattttggtgtacctgaggagaatgttctagaggatcagattaattgatcacaagattccaaactaatattttatgttcctaatttcaattatttgctctagctgatctcagtatgttaagcacctttagtcaaaggaattattacatagtcttagaccaattatatgtccataattttaatcagtctctactaagtaggtgaaattttcaattttcgagaaaattcataaaacacaactataagagattagttgagaccataacgatctcaaaacatataataatttctccttttaactgagactgacctctaaattttaaatattattacatgccaagaagatatattttaagtttcattcacgaacctctaaattttcaaggttttggagtctcatgcatcgtgtgggacccttacgtacatacttcaagtcagctaacatatcttttaaatatgatggatctagctttcatcactgggaagtcctgctagttgaaaaacgctttatattcatatttttcggttccaaactcataatgtttctcatttttgagtctgtaatgctgaaatttcgtgatcctatgcacaacgagtggccaagatcccgcaaaaagaacttgatgcacgttagtggataacaattctatgttttcgaacatatgtgcatgtatttaatcacaatttcaactgttaattttctattcaactactataagtttacattatcttctaaagtttatgaaataactgtgggtaagatgaagctggcaggttgtgtgagatattatcatttatttatcacaaatcaaaccacttctttctcaacaacaatatcaggatttatagtttcttctagcctttttagcatggtcttacaccttttttattttcccttctccctggtcgtgcctcaccaaatccctcacatgaataggtaaaattgaatccataacaaagtgaacttccacatggctatatttaaacaagggaaataagccatgagtcaaatcatcaaattaatgctgttttgctagtatgagtatgtcttgaccatagctgcataatacattcttcttaaagccttttgggtccatattagaaacaatcatgattcataagttcctaatagcaagtgccaaagaaatgtatttccttacaaccaagctgtgctagttaaaacatgactaccttgatgattcatttaagtgtaatgttgataaattagctttacagtatgattttgatgatacaaagctttaggtttgtggttttgcaacaagcctaggctggctttagatcttgtgaagttacactcaagaattgttaaaaattgttccacaagaaaaggcatagaaaagaatgaaagaaattgctccacaagaaatactgtaaaatcatgattataattatacatgaaaaaccggtttaatccagctttggatgacacgctgaagtaagattataggaatttcctttaataatatcatcttctgtgaaattacatactgacatttccgtgctattcaattctatgatttagagataggtaatggcaatattctctaaggagtattattcacaagatatcactgaagcctaaagaaagatataagaggttcatatacatctcggtgagcattttcacccataacataatctgcatgtgcataatcatttctgtactgcactacaagcttatctgcatcgtgaactttgaggatttctagcagacgttgcacatccttaacatcagaaagagcatcagcccctccataactcaggaagagaggaaggtcatttggaagtcttgtcatgtcatatgctggaggagtgggttgtccatagtgtttcatgttctcatctcggttttcgtaatcaaacattgaagtggttccttctctgatcactgatatccatatatgattaaaattcatatcacctcatgaaaaacaaaaaactattcttattaacatctgttatcagttaaatttccaacatctatgctaataagtaatatgcttcctttttatagggtattggtgtctacatgatatttaaattagggaaatatgaccacttactctgagatagatggatcatgttctttgttgctgttgactgaggctcatgatccaaaaaaacatttacaatcgaagggttcaggcagcagttttggcctgaaagcataatagtgtcgtcaatgtaggaaacaaagtgttaaatatagagatttcttttggtggttggtgggagggggttcctcagggttaatagcataataattacatgaacgaaacctgtgaaagaggtcaacaagttggtgcagtcaatgcctgtgttattgcacaagtcctttagaaacttaataacagagcccctattcaaacatgagaaaaaaaatgaaatgaaacaaatcctcatatgattggagtcactaacaagattagtcataaactggtttacttctcaatttcatcctccaaatttatttatgactattatcacgtcttacagaaaatttggttaccaaattagtccctcaaaaatttaaaacattgttgtatttgtctaatttggtgaaagattagatatttgaagacatttcactgataaaatctttggaagaccaatgtggtgacataaaagaatctttggaggaccaatgtggtgacataaaagaatctttgaaggactaatttggtgactaaaatgtttgaaagactaatgtgatgatgcatataactttggaggatcaaattcatggttttcttaaatattagttataatttacattcaatggaaagcacaatttcacgtcaggatggattctgactctgatcttattctatccaccaagaattttgtgaaatgtcttgaggaagtaacattgcagccttcttattcttagccaaagtgcagagaaattaatgacaatgaatgagagataatgagtgttacttaccctctcatattaaattcaaagattcccaaattgtacagtgactgttagaaaaaaaaaaaaaaaaaaaaaannnnnnnnnnnnnnnnnnnnnnnnnnnnnnnnnnnnnnnnnnnnnnnnttttccttttttctttgtgcaaaaataaaagcatgttcataactaaatacctctgcaataaagttttcagcagcatttttagctaggggtgaagtcatctgaccaacataagcaattgggctaagtaaggcagctgatctcaacatgttcagtaactgatcttgggaaagagcagccaatgcaatcaaagttccctacaaaagaattcaacactcttcagtcagcaacacattgaataagtcaaagacaagaaaagcaagtgtagcatgcgaaattcacctgtgagtgaccaacatagtgcaatttttttccagttagatcatgcacatacttgaatgtggctggaagatcatgtgcaactaattcatcccatgaccaattccaataatcctaaataaaaaaaacttgcataagcaataggaccaatgaaattgctgaccacagaagtgaaacaacattttctagacaaactaaccgagctattagaaggtaaagatgtatgttgccggctaaatttagttccacgagtgttagcaacccaaacatcaaacccattatccgccaaaaggaatgcaagagactggtttgaaggtagcaataaccatgttatgccatcctgcaaccacaacatcacattaattgccaacatcaactacaaaatccatgacacatagttgcttatgacactattaatttagtaaccatgaaaagtccatgctgtagaagaaccggtggcccccttgattctcccattctaattcttgccaagttaagaatataaccatcttgtgttgtcacctaaaaaccattacaaaataagccagttagtagctactagctgctctaaatcttgctcatttctggtcagaaacaataaacagatgcaagcacagtacataccaagtgttctccacaagtgtagccttgtgtcatcaccattgatgagcaaataccatcactggggggtgatgacaatgtagcggtagtgctaagtggtgataattttctcccagttgcaagagttaaaccccagaagagaatcacaaggactgttgagactgatgtggccatgttctgtttcctggtacattaatcttcccaatccagacattattatttatacacgcagaaaacaggaaaaaataatagtactaaggtattcacatgaggggttttaaaccaccttttttgtcaacagtggtttaaacaaaagtatttgtggggtctaccaaggagccactattaaattataagatttttaataccaaaaaagaaattataagattttggattttgttgccacggttctttaactttgaaagtaatgtgtggatggtttttcaccgcagaggtgactcctgaccagaccaatgtggctcatataaaaagccaaaacatgtgccttcaagaaaattttatgcaatagttgctctaagttttgtcccacaaagcatacccaagtcttgcttccaaataactaaagtaacacactggaagtcttgcttattttagacgcatggcattttacagatgtattcacacttatgataaattaacaaattagcttaattaataagtatccaatacattgtactgatatttttcaaattgttaggagtaattagcttgttaggtatactagcaggttgttagtttgttagtagtatttgtcaattttaattagctctatagcaaattaataggacaatatttaaaactattgttgaaatataaatgattaatttaaataaatatataatacacattcaagtttgcaattagtaagtaatgaggattgaattattattactcgttcctttgagtaagtaatgaggatttagtagctgaagttataataattgatactaagtaaccaataattaaaatggaaagaagtgaaaagatctatgttggttgtgaaggttgattaagttcaaacagtatgaataaccattggatacaagacgaagataatggacaaattgcttatgtggctaaataataaagatttaagttatcgaaatgatattttcactgtttgtccttcaagttgcttggagttttcatttttcaattaaaactaagaatatgacgagaataatgtaatagaagagtaaggaaaattaagatttttttttttgggtgaattcaaatattccaaacgggagctatagataaattcttcaaactcttgatctattgtttaaggcaagagttatttgccaaattatgtcacattttatttttgttggtttaagagatattcaccactagataattaaaaaaaatcaagaagtgaaaaggctagaaataatgtgactaacgcatcggtgacgagtgtttatttaatggacaatgaaaggaattaaaaattgggagatgaaaagataagtaaaaacttaacgtgtatataacaaaatttgcttacataacaattaacaataaaatatggtataaaatagcaaacgtatacctttttacgcaattttgaactgaaaaaacttgatatctatctttaaaatggataattttcaacgtagcattggttgacacgttttagatatgttatgtgcatttcatctctttgatttaaccatcttggggatgctttcttagtcattatctaataaattaacatcaaattcatcagctgtaatttcctgaatctctaaaaggttgttatttgggtgaattatttaagcattagaagaaagcttttcaggtgaagacgttgattctagaaaattttcatctctataaaaaaagcctcttgaatattgaattacttcttttagtgtccaaccattgtacattgttaagataactttaccactcattaaaaaacttaaatcattattacgtaaaaaaattggtttaataggaacatatcaaatgacattgtgacaagtatgagaagctgattttagttatctatcatgttaaaggtaatcttggccatagattttaagttttagaccaagactaacccttcctccattctcacaccactgtgaattataagacgtggatatatttaagagtgttaacctaataatactctcgtgtacatttttccttcaatctcacactaatgatcaattctactgaattatgagaaatgctaccaacaaactttttaatactttcttttcaatattttattttctaatatgtaaaattaatttaagtctcactaaatatttggatcttttatctcatagcgagtctcattcccaagctactggaatcctcatgaattgaacaaataggagagggaatattggaaacaaagtattaaataggagaggaaatattggaaacaaactattagaaagtatgttcctatcactcatcttaaattattatcttgatggaaaattttgttgttaaaattacactattaagaacttgttcattccccttgcaacacaaatttactattcagaaaagtttaaattgaatagacgtaacaaaaagtggaaagagagagatctatttgccagcccccaaaattaaaggatgtgtatttcagtatttcctccattataaattgatcaaaacagaacataagtttctaaagcactcctcccatgagggatgaagaatttatgaagctaagggcgagcaactgcaggccaaaataaaatatcagagcaaaatttgatgattattgataataactaagttgctactctgtttgtctaattgaaagcctaatccagtacctgcagccatctctatcaatattggtgcttgaaagaaccatttatagtagtgtactaatcggattttacagtaatatgtgtggtagaagcatcctttatacttgtttcaggttttttgtggcagtgtcagacactttgaatcttgtaagtttccttctaaggaactggaattgaaaccctctaggctttatcttcccaagcaattgccatcttttaggtgtaatctgtcctagcattttcatctgctcctttcggaacttcttagttgcataccagattccacctctccatcctaaggcatacctgtatataagcttaagtgagaacttgtaactaaaaggaaattaaaatgtttaaacccattgaatgcaaaatatcaaaagaaaataaaagtcaatgtgcatggcttatgaagtaaaaacacatttgacagaggaaacttgttcatgtcaaacatgtattatgccaacccaatatgaaatcaaataagtttgacatcatactagtactatcatatatttcaaactaagaaacaaccatattgaggaatgatatgtatttgagaaaacaggaaccagagataagaaatgaaatgtgtaagagtttaagggagagagtgacacattatgcccccaccccctcccatttttcctcccactcccaaatttcttctctatttgcaaaactacacctgatattaatcttcgccattgattgattatttttgtcatcctaaaaaatttatgaaaccattagtatatgaaataaaaaattcgtgtaaacttttagttctgtcatctatattcctcctctcagtgtatttataaccttgcacacagtccctcttcctctacacacaaatcaatattctgtcccatgtttccctagtacataacataaaacaacaatccaagaaaaatcccaaaatagataaattggttgggggtttgtcgaaaagggcagcagcatggtacgtaaacttgctgaatgtgggggccatatatttaactgtaggtgtgaagaagaacccaaagcgttttgggcaagcagaattatttgagtgttatgtcagaatggtaaattcaatcactaaggaaagaatcacaatgatctgaacaagagatttagagtcaatggatgagtcagggcaagactttccgctataataacttatagttatacacaattaaacttctctaactaataattaacttaagctgtgtagtttatcatcaaaacattctaatcatacagaaaccaaagccctattccaactcagtaggattggtcacatgtctttcatgataaccatggcatactataacctttcaagtttttgcatttcactatagaaattttccaaccaaccacattcatactttttgtttatgtcccacaaaatcagtgaatgctctctctctttatttttcaattacaccaatgatatcaatgctagctagctagcattatctcctgaaatataactaacaatatgttaaggagcagagcatgttgttggcaagtaagtgtgggaacacacccgatgattaaggaggttccagcagtggcgacacaagcagggatactacaacctccggaagcggaacccgcgacaatgtctttgatttcggaatgtcggagattggaattgtctttcatctacagcatgcatatttagatgaagcaatagaaagaaaaaacaaaagtaaaaggaaagagatgtagatagatggatacagacagcattttcgatagattgaagcctttgatcaactttggtgtcatgtaaatggcgcaaggaataacctgagaaataaaaaagagtgagtgaggggtagttattgttatgcaaacagagagaagagaatagagagaaacacggaccgaaccaagcagtagcaacggaagcaatggaagttccaacggtgaaaaccacgcgatgtctctcaaaagtatcctatacaaacacaaattcatgacatgagatgaaggaatcataaacagaaacataggacgaaacgaataccttggtggaaaaataagtatcttgaatggcagcccgtgaattgaggtacttttttttaaggttgggcgccgacaacactgaactccttaatcgctgcatttcatatcatacggcgttcttcccacgcccaaataacaacctgccactgccactgccactgcgactgccagggaaaactggttacttctttcccaattcaattcatctccccaaaattatatctaaaaaactgcaaattagtaataatagacttttgggctttggcctatttcacccaaaatttcaactaacaggactattacttctataaggaagctactattggtctcaacctactttgctattagtctcaaccttccgacagaaaagtccattttaccccctcccttttcctccttcctcttcccccatcatcccacccactccctacgcccccaccttcttttcacccaacccctcacagctccaccctccccccaccacagtcacgcaaccatcatcatcatcaaccacctctgtgttgctccacctccctatcccatctcttctgtgtcatgccaccaccatcattatgctaccatgcacatccatcgttgcgcactcctctaccataaacggaatcacatttccgtatggacatttggccacacagaaacgtgattttgttgtgttaaggggggtgccgcaaaatataacaatggaatcacgatttcgttgttatgtttgggatgagaaaaattatacaacggaatcatgattctattgtgtatgaatacaacagaatcatgattccattgtagtaagggggtgaaaactagtgcatgacggaatcatgataccgttgtgcattttgttcaacggaatcacgattttattgtgtataagggagacaaaaactgattggtaacggaatcgtgattccgtggggagagtgtttttgaaataaaaaagtctcaatctcttggtaggagccaagagcaattaccaagggaccaatagtaactcaattccttgctcaaaaataaaatattcatttgtacgtttatcataaaaaaaattatatgtgtttcacatatatatttcaaaacttgtgacttgtaattatgataagaaatttttgaaaaaaaaaaatccccttctaaaaattcaaagaaaaactgttataacaagtttattattttttaaataattatcttaaaataattcaaatgataatttatgattgaattacaatataaaactattttatattgtcaatgtataaatattaagctcgtaaatttattatgcctaatgattaataatacatcaaattagttcattaaattataagttttgattcatttagttttttaagttacgaatatctcaattttaataaatatatatactgataatggagaagtatttaatattatcaactaataataaacgattatgtaaaataaatttgttatttttatattaaccttaaaaattataataaaaataatttatgattgatttaaaactatcattgttaatatataaaaaaaatagatgtcatttcaaaatttaaaaaaaaaaaaaaaaaacnnnnnnnnnnnnnnnnnnnnnnnnnnnntctaaagattacaattgacattgtttaatttcaatatctaaattaataataattttagtgattaatttagtgtgtcaattctgttgctgtagagacattgacaatgcatattacaaaaagcaattctactatgaaaaagaaaattataatgtattaaaatatcaagtttttacaacgaggctcagcactgtctctttagtctgactgacaatgagcttactttcttttaaactagatttcaggtttaaaatggaaacttgaaaaagttgtctcggtgaaatagtacatccaagttgactttagattagtcgtgtgggggagggagtatgagatgatacacaaacaagtgcaaccaatactgatttctctaatgcatatgtttctttcggataagaatgcttgtttgaaactatgatgagggctaaccaaggatccaaaacattacaatcaccacttatctacaagttgtctatcttaagtcttaacatttgtctcatatttttacaaggcggacatcactctgtccaaatgctgttccacatgcaggacatttgcggtgccgaagctctagatttctctgaatgcatggattgcagaacagatgatagcacttgacaatcacaacctgccaaatacacacatcaaacttttaggtgtttctgttgcaatatattctattctagatactactacgtataaacatgcagtgcaaatccaagaaaggatgtcaaattagctttgtattttcttcatttcaaaagaatcatggtacatggcacaagtcatataactacaatgtgaaagcaagaaagtgtatgtaattggataagttggcttgtggttacctcctttggacgatcagtacagacagtacacttgatcatgttcttgcaaatccttatttctttttcaagtttttgtatcgtggtttctccagtttcagaagtcagctcgtcaattttgcagttcaattctcttagttcttcctcaagcttcttccgtaaactcctgcacgacatataccaagattcttgagttctaacactacttttgcgattcattgcttattcaatccctaaccaacattaccaattcatcattttcacaaaacttgagattttatatctctaggtcattattagaattaaaattgtattagcgagttgcttggtgcagatgtaaaaacccttgtttgaaatcctatccctggtccaaatttgacataaattcaacctccttaggaaaaaaaaaatacctttcactccccaattccatttcaatagcttccgtatctttttgaatttgatcgtattctttctctgaagaggaaacagcagacttgagcaacttcaattccttctcggcatcagccaattcccattttgcaaattccagggtgactgcaaggtgtttttcttcttggttacatttaatggcatcggatagaatagctttcatctacaggattcaattttttgtttaaacagtaagcagctgctgcagcatatttgttcggcataaaatcaaaataaattcaaaaagacagcagggcaagtttgacctgctcttcactgtgtgtaatcctcgtctttgaattttctattgatgtattaatttgctttagttgcttagctaaagcctgcttctgggacattaaagtgttgtgcgcctgttttgtcttcacgctatctgatacaagctgcattaagattgcaatattaataaaaaaaagtggtattactaaccaaaagtcaaattatttaagaacacatgcacttgctttcagtaaatagcacaacattcagtgcatattaagttcctgctgttagagtgagattttgtccttccaaaatcaattcctagagcaaaaattcatcgtgtttgagagaattgatttgtctaggtatttctccgaaatcaattatcccaaatttctaggttgatccagagttgattctaggagatgcttcccaccagttctccaaaaaccttcttaatttgattcaatcttgtaagattcaccataatttatataaatcctctttagtagtttgacacttctaaaatgatttttttatacattaaccagatatgcaaattttttcagatcaattcatacataaccagttcttcaaaatattaactaacatatatttctaatttatattagctacaaagttgaaggatatgtttttcatcaagcagattagcaaaagccaggataataacctaagcattacagtagtgcacggaaagatggtgaagataataacaaggcagtgtttagtaaagataaaagtaagacataccttaatattgtattcatccctctcgatcacctggtccaacagattttggttctgtgtttgcatatcttcatatgcttgaccaatagtctgcacaaaagcaatcaaataattatattacaagaaataagagttagagtatgaaggggaagaaaaagtcagatagcaaacctcaatttcagatatatatgcctctgcctcagcatctttaactttaacagcctcagtcagctccaaaatatccctgaatacggaaagataaaacgtgcatcgacagattaatagaaaagccagattgtacaacatttattcctttcatatgaagacaatcaatatgaaaaaaccaaaatgctaaaaaaagagagagaaaaaaacattttactttctatctgacaaagcaatacaagcaagtgtacgaaaatcacggtatcaaacaactgatataacaaataaaaagaactctgttaagacattcttttgagttatacatgcttcaaaatcaattttattttcattaaaactgtatatgttaaagtataaaagtataaaaccattgttgtatcttcacttaacatcttaagcttttaggttaattggttaatgacatggtatcggagcctctctgaccaagtagcctagagtttggtcattgcaacccctatttttaaaaaaaattaaagttaaatttcatcccaaggtaaggtgggcctgtatatttatatgctattaagtttttggaataattgattaatgaagtatacaaaatctaagtttagttatttttccccaagaaaatgttacaaggattacagacatgtcaatcaggtttataatataattatgtatgcttatgtttagagttgtttctccaaaaattaatttaaaatatttattcttccataaatacatgttaatacttagctccccaattaaaccgttagtcctcaacgtgtttccatcctcctcatattcctacaactgtaatatttatatttattctcattttataaggcatagtgtaactgcgattctgacctttgccaaataacatgatgtggcatattaaatatcccaaatgaactaatggtaccaatgaaataaatattgtttcatttcagaaattccatgccttggtaacttgttggtcatgggttcgaatcttgaaacagcctctttgcatatgcaaagataagactgcgtacaatatctctcccccttaccttcgcatagcgaggagcctctggacaatgggacatgtagtttttttttttccagaaatttcacacctcaaattcactccatgataaaactcaaaggggctcatgcaaatagcctaacacattctcccaagtatgcagtcataaatgtaaagcagcatagtatattggccaaaagagaaagtccttcaacaactctataaactttagcccgtctaccttccccactcctcatcaccagaaacttttctcccaaaataaacaaacacaaatatttataaggttagaaaaaacaaaagacactacacaagtttgtccatgaagcaaaatatcataatcagtgtagaagtacacctaaacaccaacctctcagatgcatccagcttggacctcaagtcctctatttcagcttctgcagcagaaagcctttgttcacaagcagcttcagcttcattagcagcttttactctcaactctaagctatgctcgtctaaagcatttttcagcatttcagcttgagagtgagccttactttcagattctcttacttctgaatatctgaaattcaaggtttatcaagatcaaatcatccaagtatacagatgagaataaaattgaatgcaaaataaattctctagttggttaccaagtacaactaaatgtttatcttatgttaaattgaacactaaaacctttacaaattgtgcaccatgaacagaaacacttgagaccaaaggaaaagactaaaaactacatatatttctggttgactaatctgtacaaaggatactgaatatgtagattagatacagagagaagattacggccacgggcttgcttggtatccactacccctcttccccttggactggggagacatatgagacggttgataaaagtctcaattgagatgtcaatcatgtcatagaatagacacgttgagccttctttcaaatatcatagcatgtagtgtagaagagataatgaaccaacaatgaaagttcaatggactgccacaaaagagaccaatggtagtctccctgcactcaatcatcacataacttggcatcaaataattggtggtcagtggaaacttagttcctaggctgatactgagtgcaactcctcagacactaatacccatgaacagtaaagtaaatgcgttttatcatgagaaacattaacatactagtttctaagtgcattaactaatattatttccaacagtatgtgcaaaaatcaccacactatgatgtatcagatatactttataagaaattttacctcataaatttaactgcatgaaattattgccaacacttgatttccaatcagcataccttttatcataattctcctggccatgcatatccagaacaaactctaattcctgattctccttctgtaacttttcagtctgcaccaaaatattttaatcaactatttgaaaattagtttagacaatcaataagacctctaaaatcacaatcaaataatgctagataattttagaaagcaaagatgcatatgcacatgcatgatacaagtcgaagacaaaaggtaaacatttgcaatatctgtttcagtcacagacatactcaagattcataaagtaatagataagtggcatctatcaaacttaaacccaaacaagacaactgagaagttttactgctatacaacagaggtaattgaagaagaaaatacctatagatcaagaaagacacaaagataaagccaagagaagacttaccaatgtttttaaagacttgatttccaaaacctgttcagcacatttgtttgcaaggctcttcagttcatttgtctgcttcaaaacaaagtaattaacaaaccttaatgctaaaaaaagtatatatattgtttgtattcaatggcaaaacctttggcctatttcagcacgttccaactaacatgacttctcatgtcattaaattcaaaatggtgttagtcaaaataaatatttccaatttgatcaatgaccacattttatcatatgctaaccagtgttttatccaataaccatgatttattacaacagtagtggacggtttttgttaacttgtatcagattggaagtttctcattgactttctataatttaacatgcatacagaattatgttcattaaacaaagaaatggacacttggagttcaatgtctataggaacaattaacaactttgcagcatatatttgtgggattcaataatgtcattttacattgtcaacaaagttaaaagagcttttacttgtcaggtcatgctagagatatatttcaaaaccattcttgcctttttcccaacagcttagcattttagtgaaatcatttcttgacattttacaacaaaaattaagatggctaaagacttgtgctctcatgaaagcccaactccttgtaaaagtgacaatccattgtatagactcaatctaagtagataaatttctgtggaagacctatcacaaaataagtgggaaagaaaatgaaagggcaaattatattggatcaaccttcgtgctcaatgcttctcttagtgaatgtgctttctcacgtaatgatacagcctcatgagctgcatctttccatcgctttaattgaccttccatcattcccatttctttagataaagctgaagccataacatgaaactcagatttgatatcttttctccctgaaacatttaatgttgtaagaaactgggatccaatcacatgcaccacaagtctaaacacagaacaagttatatgctgaccagtatcctgtttagcttcttccattttaatttcaagatcattcttttcaataatacacttctgcaactgaagctctaggtcatcaatcctatggtcagaattgccaaggatctgccttgcactatcagcagactccaatttcaaatttagttcattctcccattttgcaacatgaacactgccagcctaaaatagcatttagaataaaaattgtaaaaggagaaatgacaaatattaaattaaaaccagactttacactactaaaggggaaaaaggaaatcattgttaacctgcagagattccaccgatgttttatatcgggccaattcagtcatccaatgttgaagttgatcattagccaaagagtatattcgagaagtgcgcacatacttatcatctttcagttcattctggaaataaacatagaagaaaataaacttttacatgaactctataataaatgcatcttaacaattcgagaaaatatgactaaaccatcatattagataatccaaacttacaaacctgaagatcatggaactgctttgtcaaggtctgattgtcttcttgtgcatcttgaagctcagaaagacgatcagcatccactatctatgacattaagcaaccatatatcttcattacatagataacaaggacaaatgaattacagatacagagagaaagataatcacacaacaaaaacctttgcttcctcaattgaatccttcaaatcacgcaaatccatggtcctgtcagcaatgttttcaggggacaggtttccattcactgcatctgcattgggggaattcattcctattgctgcatccttttgcatttccagattgactagttttcttctactctcttcaagttcagccacaatctcatcaagctcacctttacatatgacaagacactcacaggtgacaattatgccaaaattataccaaaaatctctgcataaatctaaggacatgactccaggtcatatctattcctaactaattctaaccagaccaattataatcactgtaacttaactcttcctgataatttccctaaattactgaattatgcagttgcataattacaattctctccctactcagcacaatacaaaacatcctctactgaggctgttattacttctaaattatatttgaatttcacaataggtattgggtgagccttgacacaacagtaaggttgctgccttatgaccagtcattgattcaaatcctggaaacagcctatctgctagtagggttaattaagactacatctacctcctcaagccccaattggtgggagcctcatgaattgagtcaccttttttaaatagctgtcctttcatttctattcatcaaacttaaaatgtgcatatacattggaatattcaacaattaaaattaaaactaaaatcaaatcaaccaaattgagtgaagttctatttatacaaatctaaaataaaaaggatttcaaaatcaaatcaattaccattttataattttccaaacaagaaatttcaattttgtaaattttcaaacaaaaaactccatttataaatcacctaaatttcttaaaatactccattcccaacaataacatttcttcaattttcaatgttttaaagaccagctcattccaaactgcatggcttcattagcttgtcattaacttttaatgactatccccaagccagacagctgatctaatcaaagtactgcactgcacatttacttctccttctacttagcatcgactagataataggttttctaatttaactttggcttaacctttttttttggtgagcaatacaagaagaacgtagaaacctctacaaaaacgaatatcaactaaatcagctcgtaaatcattacaaaatgaagtccggtgcaatgtcaaatatatgaaattgagaaggaatctacaaataaggagttgcaaatgaacaatattttcaaataacaaactaatcaatcatcaaagcaataagagatgaacaatgtgcaaaagatattcaatgtaccatttagccgtaagagatgctccaaaaaatttagagtaagaccccattttggtcctcaattttttttaaaaaaacattcaatttatttctagaaagagtattacacaaatttagtcctggaaaaatactatttttcagtgattaaaatggagattgattcatacatcatataatattacactttaactgaaaaagatcatcaagcacaaggaaaccttcctttattcaaccatggcacgtaccatttaaatcatagcatatgataatcaatatcattaaaattcacactttttaatattctaaacttcaaaataactgaagtagttaaacaaaagaaaaagaaacatttcagagacctgcaaggcgtttaatctcagattgatcttgtgagcactcattgatagaattttgaatagcaactgtatactctttatgttttgcatggagagtatcaaccacttcacggaaattatctacctcctctttcgtcatatcatcaatcttagacatttggattatagcatctgcaaaccaagaatgagagacaataacagatcatttatataaatttattcaaagtatcctacaacattgatatcagatagaaaaagaacaaatcaatcgttaacaaaaactatatacagcaaccggataccttcagaagataaatctccatgtaaaacctgagctataccgcctgctctttccatctgatcatcaatggtatctttcaggagtttcaacagctcccttgtatatgactgacgcaaagcaagggcctcctcaacataactaatgatctcatcatcactgattcccttaatggaatctttctggattaatctacatagaaacatatcctcagcaggacacaaaggaactgaacctagagagtaaatcaagtcagtctcttgaattacctttatactgtaagaaaaaaactacttgtgggtgtgtataccttgaggattatcaatgtcagtcaaatgttgcaatgtgtctttgcctttgcctctcccagctcgtattccaagaagaatcatatcatcaaccaactaggacaacaaattagaaaaactaagccagctagcatattatcctacaagaatatgacaaaaaacgcattgcctcccaccctccaacaccccacaaggtcaccgaagcatgcacttcatacagtagtgttactttcaagagaggaaaatactaaatccaacagagtgcagccggtaaagaaaccaaagcatgatgacaaagaataacctgagtccagaattggttcaatgcaattaacaagtcgtcattggaacttcgctttccttttaattctctaattttttcttcaagatcatgcaaagcatgtttttggatgtctatctgttgaacaagctgttgattctgaaactgtaagactcccgcgtcggcctggggggagcatatcattccccgttacataattaaaactaattaaaaactaacattgaaaaaaaaaattatgccacaaagaaagagttgttgtgatgataaacaagagaacaaacatttttttaccacaaactctagtcaaacacctcaaagctcataaaaaaccttgcgcatctaaatttttcattttcaaaatatacatctatattttaaatgaaagactctcaatgacatgaaagcatgacacaatgcaaagaatcacaagacatcaaaatccaaccttgctactcttcatagcccagtcagcactcagcagtaagttggcactaagcacaatcaaactgccacccccttctcataaagatcaaaattttatctaaaactacactaccccaggactaaagaggcaattcattttgtgcccacgaaaccaaacagctcagagaatccaattacacacccaatttcacatttcactaaaattcagaaaaagatcatcaacggaacacacaggacaacattgagatagaagaacacagaacatatataaacacatggatacacaatcatgtagagggagaaaaaggggttacagttttgttgttggtaggagagttgatggagtttcgaggagtgcgggaagagacagaggtgagatgaggcctcttcttttcgggctcgtcgtggtctgagttttccattaagattctgaaattttgaccaaaacccaccacagcattagtaatcaaaatcaatacttgctcaattcttatgagttctctaggaataaacaagaaattgaatcaatatacagctcttctactcttacaaactaaaaagtttagggtgatgaacactgttgaccacttttgcatttatattttaaaaaaattgtattttttactaagtgtattcataaaataaatatttatttttatatagttataatttaaaaataaatattttaaaattataaattatactataattaaaatatataaaaatatttttaaatatgtaaatcatatgttaaatatgaattataatctaaaattttaaattgaaatggataaatcattaagaaaattaaatatatacattttttataagaaaatcgaatatatagatttgttataggaaaatcaaatatatagatagaaacaaaagaaaagttgtttgagataattaatagagataccgaaagccagatttatttgtgaggtgaatactattcattgcctccaagaggtgttgtttattgtttttttttttttttttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttatttaaaggaaacaatcttgcttaagttaagtaggatcattatgaaaaagaaatatttttctaagtattcatgacaacttgatacctaagactcagcaattttgtttttttatttttacttttaaactctataaaatcatttttacttataaattatataaaataatttaaaaaaatcataaataattttgttgttgaataacattgattttatgatgttgaaatttttatactgaataataatttaaatacaacttgttaatatatttattacaaaataatattttgattctatgtttaataatttcacataagaaaaattttattttgaaattaaatttatttattatatatttttattatacctatgacatattatattattgtaaatccttaatgaatcttttttcannnnnnnnnnttagagaacttaatagttagtaatttaagtacatttttctcatgggatgaagataatactaaccacatgtaataatacaattgcaatgagtatcaataaaatataatttgtctgtttgagattaaaataatactttattttaagtaatattgatttcaatagtttgcatctaatttaattattttttacattttaaattattcataatattatttataaattataatattataaaaataatattttaatttataatatagttgtaaaataattaaattattttattatttcatatttttagattaaaagatatttaaatttatcaaaaaaagttaaatctgtttttaattttgatacataaaaaaattctcatgcaattttatgaatattttaaattaaattatatatatatatatgcaattataattaaataaattttgtctacttgaattctctcttgttctttttgccatttggagatcttaattattgaactatatttgcctcaataaaaatatttataaataaatgtatttcatgcttcaaaatgggaataatatgtacaaatgcacatgcacttacctttctagtttgttaaaaaatatccttccaaatttctttatcttcctcgtatgacaagtgtctcaccatttggtaaaaataaattccctctcaaatttctctctcttcctctctaacttttatattttttctctattaccttctctttttttcttacacaatttttttataataactactctttttattgatattactagatgtaatgtcgttgtgtagcacatatttatctaaatataaaaagataatttaaatatattaagaaataaaattttcataagtttataatttacgtaaatgatatttttaagatattttgtgtaattttattaaatttcagcttgttaattgttacttttttttacctggttattattacaaaataaaatatatcaaatattatagttgataaaaacaacttatcaaatattttttataaaatatatatttcatatttattaacatttaaaaagaaaaaaatagaacataattagcctagttctataatcattaaagatgagtctaatttttaaaaatataatcataataatattgtggttggatttcatatttatattatttcacatttatatagtcaatatgaaataactaatttttataaatataatcataataatattgtggttggatttcagacttatattatttcatattcatatagtcaatataaaataattattttattataatgttatgtttgtaatgattaaaaaagaggaaaataagaagattaaattatattttggatatatagtcattttcgttcttgaatgtatagagtactaacaaattcgtccctgaatgtgccagaagactctttcatgaacgataacggacggaaattaacgaataaataaatttgttgtacatttttcattttcagagactaaaattgctattcacccttttttaaaagatctcacttcaaatttgtaataatgcacttcctctattttgttataattgtcatataagagaaaataaattattataaaataattatcattttagttttttaatgtaatattaagtatcttttttatttatatctcttataacattaatggttgacgaaaaaatttataaataaaataatgataatataagattacttttataaaattattattttatttaatctatttattgatttttatgtatgtgttagaacaaaaattataataatgggatagaggtaatatggtttttataatataatattaggatatataataaaatatatattattttataagatataataataatgtaaattgtattgggatgattaatattaaaagaagtattttaataaaatttatattgttttgtttgttctctaaattatttccattgtctaccaaatattatattggacaaaaaattatactaaaattcaagccttgtcatgtgttattttccttgtactatattttagtatgtactatcaaactcacccttaatttaacattatttacccaatagtttgcagccatttctttttcgaaacaatttcatacgaattttattcgtacgatacaacacctgtatttcgaatataacaattgagccacatgcactcttctacccgaatatcatattaacattggcattaagcactaaaaacactccaagattccctatttgggcaccttaagtacataaaacaattacaagcgaaaaatttaaaagtaatcatctgtttatagcatcaataggttaagaaagaaaattaacctaccttgtccaaacaatgcaatacatacatgcataattagggtacgtagatgcttttttttttttttcctagtaaatagtatatgtgcccattaggtttactgtttgtagggtctaatagaccttcgtttacattcatgtaatcctctttgtaattttgaggattgtgtttaggtaaaatttgacaagaaatttcacaactgaacgcaaagtgttgttgtccaaatgttgttctcgcatatcaaaatagggtcgcttttgggctgcaaatgtaagggcttaatttataatttctcacaacaacttgtctaattcatccttaattacaataattgtctatcattatattatacccattttggtaatatcatatctaaaggctaaagtctaaacacatatcaggtttcttaaaatcatttctaaaaagatttaactattttcggaacaaattcaaaattgacacaatctatttgtgaatgcgtaaatgatttaatctttgacaaaaacgaaaaactacataaaaacattgtaacaaaaatggtataagaaaacatcaaatccccacaagagatatacgagaatttgtcaaacataaaaagcactagcattaactgagagaactcttttgttggagaatttcgtaggtgttttcgaactccgttctattaaatgtataccacataaattagagaaattcttaggtgcacctgtagcaagatattttattgctctgatccattcattgtgacttattgttatttcataaattaatgacaatttttaatttttttaggtagattgctgacatggtgaacaatgaatggattagagtaataaaatatcttgctctaggtgcacctaagaatttctccataaattatgtgaactgtaacgtagtattttgctttaagtatattttaatgttatatctgaagcgaaacacatccagaacattatttggtgcacttgaacaccaaattcatcacctcacatgtattgatctatatatagtagctgaatctaagtatgtaaaaattaaagtggaaccatctatatgtagatataaagtattattataattattcatggaaatatgcttcctttccgtaatacttttacggtatgtttctttttcttttatttccagcttttcttaatgcatttttaatcatgaaggatcatttttgttccatctttcttgtttttattgtaagttatatgtgtatttgttaaaaaatcattattcacggggacgtaaaaggatatccgtttatacaatcattacaaagctggattcttttgcttataataatagaaaaagataccaatatccatatcaacagagaaaaatcacagtttttcgtatcttattttatatttaaaaatgtttactataaccaaaagatgttttttcgtatttggaagaaagcagatattcccattgttccttgcgaacaaataaatcactagccacgcttctttctccattaataaaaaaatagcagaatgactttaaaatatgttaaatttagagatgatccaccaccattcattttcggtaacattagccctaataatcccgagaagaattgtaacaaaggtacacaactttagtgtattaatattatacgcactcggttacaaaggcagcaaatagcacagtatccactttctgtttagaaatcaatcatttccgaagaaagcttatttcaaatcagaagcccagaaaattctccactttatttccgaagaatccactttttatttgtcttatcaataataggttattaagaaggtatcaatctcaagttcaaattggaataccatgcaaaaaaaagtttgacattcaaatcctttgaattttatggtcacaactttcaactgaacgtacggcttaaacgatgtcagaaattttatgaaatgaaatattattcaccttagctaatacttcagacagaaataaaaagaaaaaaattcaatcatgaaagataatagctccctgaataactttgtccaaacgaagataacttcagacaaaaaatacacgtacattctttctattacacaaacgaagataactttgtccaataatttatttattttaaactaaaaaatgattgtccaaaatcatgaagagaaaattacgggtctgggattccctcacagatgtgaaaatctaaattttgtggccttgaggcatgaaacattcaagacccatgctaatcattacatatctaatacatgacctaattttcctatatctttcagggaatgtctctaccattaggtataccagtcctattttcttttacataatttctcaaaatgattgtttgattatcgaaacaaaatagagtattcttaaaaagaaaacggatattcccctcaaacgatctataaaaaaaaacctagttttcgtccgtataataatgtttatgatcccaactccataaaaaaattgtttataattccaacatcttaaaagaatcatatatttttagtctttgataaatgatgaaaaactcaaatcacatcacttttataaatgcatagactaaaaacacgttaaatttttacaggaactcaaataaaatagggagatattttgagaaaacaaacatattttaccttttttaaaataataataaaaaaaaacgtagtcgaataaaaagtagcaaaactaattcggaactagcaatgaacacaccttgtatatcagatcatcatcaactatgttatggatctccaaagaaatgatcgtgaattcgtgattaccgttgcacgtaacacgaaagatttgttgaaaaaattccagattctgaaacaaagaatgtaacactgaaaacccaatcccaacgcaatgcagattggacaagaagaagagaagaagcaagcagggaaagagtaattgattagaatgtaatttattctatgatctgattgccataatttttgtacagaaaagtaaaaaagaaagaaaaagagagagtaagttctaattgggggggtaagggtaaggtaagggtaagaagcagatccatgaagaaagcagaagcaccaaccagttttccagatcgtccaatgctatgacacagtaatggatccaaataacttacaacaacacaaccttccatccatccatccatctccatgcctatattataatatcactctacaacaccacaacacaatctaacaactttaattaattaagccagagatagtgaacaacaacaacaacaacaagaaaattatgattataccgacaagaggctcttcttcatcagaggcacagcgcggtggcggggagctcgtcgttttcgtaggcggcatcgggcggcaggaggtttagatcgaaaggaagcggttgccggaaggaggaggtgaggacgcagtcctggtcgtcgacgacggaggaagaagagtcgcaatcgctgtggcaatcgtcgtcgtcgtcgtccagagggatgatagggttaacaaccacaaggggcttgcgagaggaggaggagggaaccctaggcccgctgaaggactccacggtgctgctcatgccgctgctggtgggccggttcacctgggcgggctcgaacttggtggaaagcccgtgggcctggtagagcggcggaatctgctgcgaggagtggtggtccgtcgggacggggaaagaggggaaattggtcttggccttgggcccgcggaaagatcgggctgccttgtcgtaggcccgcgcggcatcctcggcggaatcgaacgtccccagccacacgcgctgcttcttccacggatctcgaatctccgccgcgaatcgcccccacggccgcttcctcacgccgcggaaccgcgtctccttcgcctgctccgccgtcatatccacgacggcggcggtggctctccctcggcgcatcttgatcacgatattaaaaaaatattatattttacaagaacaagatcgatcgagaacaagcaaggagacaccaccggcttcttcttcttcaaaccccaattcttaatcttattttttttccttcgtttaggtttggggtcccatgatgcggtctcgcctcgtttgctccaatagattgattatacgtgtgtggaatgacataattgcccttttgtcgttgtgtggggactatgccccttacgctagtgtgtgtttgaattttcagtgaacatccatttgcacacatccaagtccaccgaacggaaacgttccgtgagagaaaggattgagttgaaccccgttgaagggtttttaattaaaatccaaacatacttaattttttttatctcgatatatgtaacaaaaaatccttttttttctttttctcgaatataataagtaaattttaattacttatatcctgagattctctttaaaatattatttatttaatgaggttaacaaaaattttatgtctgatttaaacttcaaatgaaaaagtagtttaggggtttggggtatatgctttgtcgtaattattgttgttattgccttcgattccagaccaaaccaccataaatgggagcaaacgttactttgtggtatttgcgatttgccaaatgtaaattaacgttttttaacttgtcaacatgttacgctgagggttagattttctttgtaatagatgtaaattcatttgcatgattaattggtgaagtctcgttggattttcaaaacggtagaagctgctaactaattttcattaattcagcaatcgcaaaatccaactttgtggcttagttggttgaatttattttatggtagagtaaaggcctgcttattacagtttttttatataaaaaataatactggtaactttttttaataaagaactaaataatttttgttttgattgaaaatatgtttttttaataaaatcaattactacttctttaagaaaatacttttacgattgtaaacaaatattaattaacatacttttttgaaatgtttaaaaaataactacttatttactattttacatcagacacttttttcaatatggaataaacccaaaagaaaacacagcttgggtcatttttatttattttttgtttaaatatgggtcaaagcttggaacggacatccgagaataaaagaatggcatgggtaaaaagatcattttaaaacaaatacatagactcatctagcatcatcttgattttttttttaagatgcgaatttaaatgtgtttactagtattttatatttttgcatttattttaagtgtgaaatccatctcaattaatgtaataaaattgtttccttacatattttttgtagattctaattttttacaccactaattttttttttgtttgctttatttattagtttattcacgggtattggaaaggtaaatcttaaaaattgaaaatatatgaatttggaaactaataaagcaagcgtagaaatatccaataacatggttttaattatagtatgtatgtttgtttcaagaaaaatatatagtctgtatgtttcagtaaaaaaaaaataattatagtgtgtatgttgtaacttttattcggtaactgtaaattatccattacttatatcatgatttacaaactactataaatcataaaggatttgctatatataaaaaaggaaaagaagctgaaaagtgtctgaagtaatgtttcttatagtttacatgattacgagatttagttttccacacattaaattttcttgtggcttggtggagctggagactaaaataggttcaactgttgaatatacttttcaaatattagattatttatgctctggccaaaaagtattagatttgtctatattaaactttaagtcatgatatggatgaaagatagaatgttaaaatattgtttatagccaatgcctaaaataggagtctatattataaataacaaacattattttatactgtaacatatataaacacgcgtacatttaaattgggtgttcataagaattatatataaataacaaacattaattacattattttatacaataacataaacatgcgtacatttaaattgggtgatcataagaacaagcacatttaagtgccatatctaatcttaaaaattctagatattctcatttgcattcataaaatcccagaacaaaaatccacctaaaatcttgaaatttatagtttgaagttatgtaagttgaattttagaagaacttgaactacattttgatacatttacaccattacggaagcacacttatgcctagttattggaagctaggctaaaaaacttacttgttaaatcaaattaaatatttcttcacccaaaaaaatgtattttttatgacaaatttatatttagacgtcaaatgattgatttgatatatttcttctacttgaaaaaagacgagggagacagggagttaattgaatccggttaggaacaccgacggaagtcggaaggctttgcatttcataatttccattgtgtacacaattcaaatctcttgtcgtcaagaattgtggaatagttcataatgcgttaaccaaattctaagaagaaatctaattttcaaaatgcttttatagttttctttttacaattggtattaaattagatgagatgtaatgggaatttttttaaaaagaatatataaaaagattcttaaaacaatagagtaataacaaataaattagatatgaaaaaataacaatggacaagaaagaaatatcattaggtggaagaaatcataacattttctctctctctcctctataatattttctctcttttgcataatactactctgagaccttaaaagagatattaattattatctcttaagtcaatttcgacttcactttatgtcaattatatgttattctcaaacataagccttagtaatgaatcaaaaaggatgaaaatgtgtcgagtactgtttgcattagctttgagaattcttatgtataagattaagacaatgagaatagtcatgacaggtcctggcagcattggaatgctcttgagaggatccttagaggaaacctcaaatgttgcattctgttttggaggaccaaaatttattgtggaatattcggaccggaaatacgtgcatatttttttatatatccaagttagatacatttaccttgcaaattataactattaatatctaattcataaatggttaattgattaataattaactatgattgataatgagttaatttattggcctaactcgtccaacttgaatgaatgtgtttatgtaatattttttctatttggaacttgtaacgtgatgttatagtacatgtgttaatcttccatgtcagttttattactagagcatggacatctccccttagcagttgggttgttggactaaacgagttaatgttgcaacctccttatcaaatgacaggtacttaattatttataagccatcgtattatcaacaagttacagattatctataaagtacacatcatttgtaagctcaattatctataacctacaattatatgttagtcaataattacagataattatatacaagggttgttatatcactgtaacaacctcgacatacaagggttcgatgctctccttcattctataaatatcaggtttctgcctatccctttcacacactaattcacactgagagacaactgcactcacactcttacatgaattaatacttaatttcgtatattcattcactcatacatacataattaatgtacttacttgagtgtcagagtcttttcctttgttttgcaggtccctcctcttaacaaagtcgattcactgtcttacgtgtaaagatctggaacctaccttaatcatgtccatcttgacatgcgctacatccagattttagtaataacaaaattataagagtgatttcaaagggaaaatattgtatatgctgctaattcgagcgaatgtatgtgacattagttgactttccccccaccccgttttgatttatggatggtgatttggaacattcatgtcttttgtacttcttttttcccaagcatatgccaaatgagaaataaaaattatctattattatattataaaaatagatttcagccgtgaagtagtcccagatcaaatttcactcgattgaacttcatttggctgaaacttaggcttttttggttcaatgattaccatgtctcaagaagcccctttgtgaaatattgtagcgacccaacgaagataaagtaatgggacaatatctaaaatagtaaaggggtgagatatctaagtttaaagtagaaaatcaaattaaaaactgtaatggttggtacatcaattaggcttttcatcgatctatcatagctaaagtggctaatgcaagaatattctaaaacatattaaaatcgagagagcatatattgacaaacaagggaggtgtggggaagagaatggaataaaaaaaaaggacaaagtaatatggttggtattcaatttatataaactaatcaacacatgtttaaacttatgtttcacacgttaatatgttttttcatagacatctacattattcaataaacggttcgacactaaatgtatattctcattgtgcaaaactttgaaccgtaatctattattttgtaagaatatgttccgtatactaaattcaacttcagatagttttatataaaatttgaacccaaacacgacctagcttgatcgaccatcgtcttaatctgtgttttttagtaataaaacgtggtgaaaaaaaaaaactgttggaaggacataaaatttaggttcggtaaggtttgctgtttacgggtagaggaatctaaacaaaggtttagtagatgaagttaagttaactcatataccaagcttatcctattcttatttttttattaataagaataaaaaacaggtatcaaaacaatttacatattttactcaatcgattgaactagatacttgggcctactctagaattctagaatttagattgcaaatttttttcagtccaaaggagtttaactttgtacgagtttcaagataaagccaaggcctattatcaattttcaattaaaaatctaagagactgatttaaaataacacaacaatgaattttagatttgcgtcctttgattttcttcaataacagaattatatcctggccatgagaagcatatacattttacaatgcaaaaacacacacaagtggttgaaagatctcctaattatatataaaaatatcttgtttactaaaaaaatatcaatcttactatttaagaaaaagagaatctaaatccattggaaaaccaccaccactaccgcccactgcgtaatgctcttggattccgtattcccttatttgtctcctcttcctttccattctttttttcttcttcaaattggcattttgaaccatgccacagaagatttaaatcctctcatgttcttttcctaaattacgagataaaaagacaaaaataagtttaatagaccctactcacgtgataaataaattttcctatagttatttgtctttctagtttatactcacataaggaacatgaaagacccaaatggccaaatctgttacaaagcacccgacattaacttgaatttccaaactccacatagccccaaattaaagtatttgaacctctgaattatttttttttaaaaaaaattaatagttagttaggcacgcccttaaaaacggagttagcgacaagtttgtcatacttcccttaatttgtcatttagcatttttaaatgtgtaccaaaccaaccccgggagagagaaaatgaaaaatgtgaagggtcataatctttctacctgcactttattcaccacaaaaaatgccttccattcccccacaagccagtggttgtcacaacaacctgtgaacaaactatccaactccacagaattgcaggtgaaaaggggggaatagatggtatgtattatatacttctcctgaaaatgtggggaaaactaaaatgtccaaaagaaagagaaaaaaaattcaaacttcaagtagtttttagtcgtgtaatggctctgcagaagccgggaaggaatttgatgtagtatcatcttgtttggatgaatcttctgtagcagcttttgcatcagaatgctgaagcttgttgtcacttgataatttagaaggagatgtctcaggtgattgtacatttgataaccccctggtcagaggagtatcaagtacattcatagcaggtgaggtcaagccatagttctgcgggatagtcaaaactggatgatcaaatttgcatgttgggccaaacttgcacgttccatagattctgtaataatagcatacagcttgcccctgcagataaccaagataggaatcaggaatctaaatacttaaaaaaccatacatggttagccaatatgaactgtaaaattaccttcttaggattttagggaggacaatatgaagtttaagaataaacaatacatgttctgattttttccattgccatacaatcacaaactatcatgtattttaagtccgttgagttttataataattattttaaaggtcgtatcttggattatatttcatggttgacggtgtaaaaacttttaaactaaccatgcatgtctattaaactcattggcctcaagtagaagctgaacttacaggtctcacaggaaggccgagtggatttattaatgattgagatattctttcctttgggtggtggaacttgcaatcggatccatatttgcaggtcccagtgctcataaagtatctacattctggttgatctggtctattcgggagaactgaattgattgcctgccaaccaaaaagtgactcacccagattcatgtagtcataaacaagattagatccaagaaaaccgttcggcatggcagggttcatatttccctattttgagaaacatagtcacagtcaaaacaagagatttcaattagcagaaagtaccatgaactgcatgtactatgtagtaaccacaacccaacataattatcactaaaaggcgagatgctctgaagatttccttaagaacaaggcacattctgtatcagatattaattggtatatgtatgccaaatgtgcttggcaattaatgaaataaaatagatgaaaagtgtaaggaataacagtatttccatacacagatcaattccctaaagttccttgcaatgtctatgaaatttagtagtaaaatatggtaacaatattttataatcttcatgcatttatttatctagacatatcagtcagacaacaaaattcacaatgcctccaagtaaagaactattgcctaacgcttcatgcagcgatccaaaactattatgtatggagtaacatttctgtaagacagcataggagcagaatactatattgaactccatctttttttccaaaaaattagcaaatctgtgtaacccttgcaatcatccatgaagagaaataataccactcagatcaaattcaatgacaggataaaccccgagcagaagagaaaaacaaagaccagagcaaacagcaaatgtatagatatacaggacattgaacacccttaactaaccatgtagttgttccagctctgcacaggtataacaccttgtgaagaagacagaaaaggaggcacatatgattgaaggccttgtccagataaatacgacattcttggtactgctgaccatgcaggaaaccctccagcatatggtaaacctgatgtaggaataattgttgaggtaggagtaggagatccaccagccaatgggtatgctccgagggaagcatgctgtggatgatgaaacttgcatgcaacaccaaacttacaagacccagttctcatgtaataggcacatgatttttcttcctaaaagagacatccaaagaatgttgaaaatttgcaatggtttctttcatcaacacagcaacagtaatcaattaaaaaaaatgctacaagtgcaaaaggatgcacaaacctgacgcatgggaagacctaaagtattgaatgacacgggagcagcacctcgcctatcctttggatgatgatatttacatgttgatccatacttgcacgtcccagtcttaagaaaatactgcaatgcatatttcaaaagagattacaagttactcaaattgaatagcactggaattgttaataaatctcccatgaagatggactctgtagcatacaaattttttcagattatactacagtttctgaatctgatatttatagtataatagatgttaaacttaagttcatatacttatttcctttcctggtttaagtatgccatagctggcatcaaataaaattttgccatcatcatcataatgaaatctggtaaataagttctaaaggacaaaaaccacataatatgaccactaaaaataaaacaaatcatcaatagaaaacaaaatggtagcagttatacattgacagcataactactttatttttgtccagttcattaggtatcctacttcaatttggcattttctttcccttcatttattggtttgatatctgtgcactagtaatcactagctaaacatttcaaacagaccagatttattgctaaaagggaccacaaaaaaggacaaacataaatgcaaaaaagcaagtaaagcttctgccagagtgacattgcaaaatatgaaacgcatatcttcttatggagtcttccacaaacacaagaaatgttacttttttattacaaaatctcccccaaaatttatgttaaagggaaacaaatatattttatttcactctaatattcttgcataaaacacatccccgatcagttttatgaagcataattctgttctgactcatgaaccaacaactatccaaagcttaagttgttaggtaaagacacatgaatggctttatattacatccctaataaaattcaacacaagaaaaatgtcacaaaaatacattttcattcatcaaaataaacatacctcgcaatcaggttgccctgccctctgagggagttcttcaccataatgagtaccctgaaaatctaataaagtatgagaaacttcaacaatttgtttgcatatgataaaactaataagcagattgaagattaagatacaatagaaacaaactaaaagattacaattacacaaactacatctttttgtcgaatatttggcaaaaagtgttgtttcatatatatatatatatatatatatatatatatatatatatatatatatatatatatatccagaagacaaagaatgaaaagtaaattaaagaagaagctcgtacagttgaaatatgagcagggtgatggtagcgacagctactcccataaccacacactccagtcctcaaataatataagcactcaggttcaccgtgtcgatctggatattgggtagattgagctgcagcatctctatcccaattatcattgattttcaaacgtcgaattgcttctacgatgcagatcaaaaccaatcaggcgaagtctgcccaaagtctcatttgaacaaattaatgcaacacaactaactagatcagaaacttaaaactttcacctcaaaaagcacactattgttgcctaaaagattttaagatcaaaacatgcaggcgatccttagttgcatcattaaaaaaagtgcatcaattatgtaaacccatgtatgatcaaacacaacacaacaccatagtttaggaagaaaaacacgaaacgagaaactaagccatgtttcccaaaacaccctcataggtatctcacaatacattgtgtgaatcatgagaattctccaaatcaaaatcatcgtaccataaaaagaaaggcatgatatcataaatgaaacaaaaatcgttgagtaaaaaccatctaacatctaacattccctagcaaaacaacataaagccatcatcatcaaacgatgatcggagccatttaaaccatgaatcatgacaaacaacaaaggaaaatcaatcaccagaaaaatctgcaccaccttcaatgttgtcaccagaatcagcattcctcagagcctgcctgctttccggcatctggtagagttgaaattatgacaaaagactttttttttttgcttgttcgatcaaacccaaaaaaccctttgagcctttaagaagaaatcagcgcacaacaatctcaaattaactcacctcacatggtaaaatgatcatcaggagaccgtgaaaattgaccaaagactaaaaaacaataaaactgaaataaaataaaataaaaatcctggaaactaaaatattaaaaacaaaacaaaggtacaaagcgagaatcgcagataaaaatgagaagaatcaaatgggaaatcttaaaaagagatttaataatattccaattggatgaaagttggcgtcacattcgattagagtttccttgctgtggttctgcaatcttcggaacattttggatctttaaatgtgaaacccgacaagttaatttataattactaataacgataattactatttggtgaatgattttatttttatccttaaattccattttaaatttcaattttttttctaatttatatatcaatttcctataacttttatatttttattttattttattgtttttattaactttattatttaaaaaatttaaagagtcatgtctctcttccccggcaataattattaatacgtacagtgtgtattcttgcgcgcgtgtacgaacaataaattctctgtaccatattaccctccacgtggctgctccataacatgtttacagagtttacgatatccaagatttattactgcccctacggcgcgtgcactgcaatcactactacaaatttggattgttaagaaaatttaattagcctgaaaaagtagatgccaattatggaattggtaagtggcattttaagtttttaacctcttgattttatctcacgagattaaccactttaattcctttcataaattgaggtctccatttttagcttcacattcaagcggtgataataattttgaaaagacaattaatatatgacaacaattaataataactattacatcaaatgattaaaaaaatctttcaaaaaacctaaattatcatgtaatattatcattcaagcgcgcaagaatcactactacataattatcataatcaaatattatcattataataataactatgaaaacgacaataatcataacaatcatgatgataataataattaatgataattttagagaaaaatcacgaaataattgaattattttttgtgtaataaatattttacaaattacatttttattttgtagatgttttagagatattatagttatattatattttaattcaattttttaagtattgtaatcttaatctatttttttttttataattttgatccaatgattattctcatatttttatataaaagaatgttctaatttgagtataagtgtcttaacaagttatcctattagcatatattttaagaccatttataattataaataattaacacactaaaaaaaaagtgcatgtacaataataaattccacattgacatttattaacatatatctacttaatttttagcatgagcactttaacaaactatcttattaatatattcacacacgttttacgattttatgttgttaatttaatatcttaatttggctattttaaattcaatgggtagaacaacaatctatatcgtattgtttgcaccacaatgctatttttccataaaaaaaagtattattttttaaaagtaaatagtttataaagtaatcgtgtaaaacttttttgtattattgtccaaatacaaattaatattatataataaatttattaacttttattataattatatttattttcaaaaatagatctatcataatttttttattagttcacagtataaaatattttgtacttttacattaaactcgtttttttaatatgaaggagccacaaagtatgacttttgagacacggagaaccaaaacatacaatattttattttgtaacgcactcttatcacctgaataatgcataaggtattaacccaaaaattagtcatttattttttaaaaacttatggttttaacgtaatctatcattttttttcttctggaaataatatgtcctcataattaaaagtcatgatattaattattgagacataaaaatcatcaattggatttggtctcttttcataaaatattttccaacgtaatctatcatctaatgtatgtaagccgatattaaatatcaagtattaatattattattttaaatatatttttaggctacgaaaattgtaatttttaattagtattttgaatttttcattttgattcttatatttaatgattttatatttttcaagaactaattaaaaaatatatagttgaattacacacaaaaagttatacttttaggaaataaaaatatatttaaattacttttaaattacagattttaaataatggtaacgaaaatacgtttgaatgatctttatatgcttctatttgtagctgctaatctaaaaaaaatcattcattttagtttttcagctgattagatgcaacaaattttcatttttatctccaacttttttatttattttaacagtaattaaacaaaaaatatttatcgttagaattgataaaagaatatatttttatcagcctaatcttattttatatttgcaattgtttgaaagatatattttattcttctttcagattgtttttatttttactaattttgaacaattttaaaaaagtaaaaagaagagtgcatgaacttatgcacagtaccacgctgaaagaaagtgaaacttcatctttgatgtgcatagattttttttattcatgatgtgtatagatttgattactatacgctgttaaagtaattatttaattttagtattttgaaataaatggttttttaagaaattacatttaaacgaactaatccaaacacgttatattttgaggaaccctcacagttgtcttaatacacttcatgaattaatacataacagtagttctcaagaaattaaaaaaagaaaaagaatagtccatattaccgcagtaagtgagcagttactgatgaaaataatggcgcaacactttttaaaaatctaattgtttgggagatttaacattatgaaaaactatcgttttctatcaatgatctttatgtaactgttagatttctaattccaaaaatatttgcatttatttttatctttaaccactaatattaaaatattatattaaaatctaatcaattcaaattaaattattaagagcaataaaatttctatcctaatttttagtataagtatgaatgggtgtggacatggataaaaataagtcagatgatctatcagagtctgtgtcctaatatgtccaagtccaagaactgatttgtttattaaataggttagtcttaagttttctaaaaaacctttttaactagacaagactaaacttttgacttcaaaaaaagtttttaaagcctgataaacaaatctatttatatatatatatatatatatatatatataagtatataatatttatatttaatatatattaatattatcattaatatatataagtatataatatttaagtttttgtgaacatgtgggcatgtgttttctttgttttgtggagataacataaaaaatattgaccattgttaggaggcaatattctacgatgtgaataaatttctgaaagaagtttaagaatgtcgatgatcgattaaaatactcttttgcaataatgcagaacaaaacctaaaataaagaagtgagtgacactaataaaaaaacagatttttgagtatttaaacttacatattataaaaacaaattaataattaacaaacacataagatgaaacttgcataataattttgttattctttttatttatttataataacttagagactcctcaattcttttatagtaagataatgggtgttgagagtagtattaaatatataagttaaaacattttataatattataattcttttcatacatatattctttagactacaaacatttttgttgaaaacaatcttacttaagttagatgtgaccactatagtaacttgtgcatatgtatatttagtcttaaaaaaaaatcatgatttttcgttttaatttctgggaaaaaaattagatttagttcttagatttaacaaaagaatatgattttatccttatttggtacgagagaaatggaatgggaggagaggaggagatgatggaaataatataactctagtgggagttagcatttcaaagtttattgaattatttcaaataacaaatatgatatgaaagataggaaagtgtaaaatattataacacatgtaaaatcatatgagtttctctattgtagacgttttaaggaaagagagtgaaaatatttgtaaatatagtaaaatccattgtattatttctaacatatttttacttatatttttatccctctcccagtatcttcttctctatttttttaaaccaaatattaataattttcactttatttcttatctatttttgcttatttttcttattttcatttatcccatttctttcatttaccaaaaagagcattactcttttggtataaaactaaaagtatgttgttttattaaatgtaagcactaaaaataaacaatttattaaaatacaaaatcatgatattttaaaaattaaaagcatgtttaatctttaattaaatataatttatcatttaataaaattactcctgttagattttattaaactataaaatgatcatttttattataattttttatttataaaaataagttattaaataatttataatatttcagacatcttatttaactaattaaattataacatgtttgtaaactcattttatcttattggctacgtttcaagggacaatttgttgaaaagtaacattttcttacttttaaatcaacgtacttttgagggatggagaatgggtgggggggaaccaaacgcactattagacttcttggtattttattgcagtttacaaactatattatattgtatagaataaattgtgaaattgtagctgttgattcaaaagatcgaaagataaatttttgtaataattttagctaaaaaaattatcattaaaagttaataatcttttttaaaaatatgccctttgcttgcattttgacttttagattttgccgacgcccaacagttggtggtcaattttaacattttgtgttttggtcaaacccacatattcgttggcaggaaggacacttcatatagctcagacattgccataaccatgcattcaccaaaaacaaacaaaatcaaatgtattaattaagagaaatgttagtactatgttatatgatacttttttcctaagattctttttatatgataagataactttttttgaaaaattataatttttttataagttttatttgttatttgatgatttttcctgatttatattaaataagatttttatatcaaaattaataattttttataaattataaccaatcatataaaaagttttggagaaaaagtgtcataaagaatgtcactaataatcctcattaattaattattaaagaaaaataaaatagaagacttcaaatttctttccgttaatgagaggagattttggaagatcttgaccgtccagttgcgaggaagaggacttcgccgtctgattcaagttatgtacgatgcattcgtgtaaaacggtgaaataatctagggtggttacaatggttgaaaagtcatttcacacagtgccataaggcataaaacccagaatgcagcattgacgtatcggtgttgcgaaaaatcgtcgccgttaaagtgatatagaaagctaagcttggatacgcggcacgtggaaatgaatcagccattgattgcaaaagtcagtggtaggcccatcgtttcttcatgtcggcaattgtattttgatttaaattcttaaatggatgaagcatgcgattttgcatcatcaatacacatatgatgtaataataaattaataataatccatcattaatatttttcattaaatatttattttcttataactatcagattatatcagtaccaaaaaaatacaagcatttattatataatctcaattgtaacttcactatttctatatcagttaatatgatattttttcaattaatgcatgatttttcagtttaattaataatttaaaatttaaatattatttaaattaaatatttagaaaaaatattacttataataattctaacctattggaataagattgttttcggtagaaaatatctgtatctttattaaaacattacaattcgacaacaatataagaaaatattacattgtatttaattaatgctatatatacaaattagtaaaagcatttaaaataatgataaatgtattactcgttttttcatgttctccttgggataaaaaggcttcatggtcgtgaatcaaaacggcttacaacaaagtggacgaggatttcgtgaagggaaacactagaattagtggggctagatagaaaccttacatatttaattaaccaatgcatatgctcggttattatggttataaatatgattggctctctctcaacaaaattctgcctttcaagaggaattatataaggggatcaaatgatcatacataggtctatttgtttgggctagcaaggaaactagaaagaataagctactatatactgaagatggggttgcctctaatgattagcgtggtccaaatttatcccaattgttttttttttttttttttttatggatnnnnnnnnnnnnnnnnnnnnnnnnnnnnnnnnnnnnnnnnnnnnatttttttttttttttttttttttatggatgacattatatatgctggtggaggggtgtttaaaaaaatgatggatggattgtaatttaacttaaattgaattgattttttttctcaaactaattcaagaaaaaaataataaattattttataaaattaattcaattaattaaattatttttataaatttgattcgattaacttaactaattctcatttgaatattttttatttgaaaaaaatagtttaaaaatcactttgagactaatctaatttttagaactaatttaaaactagttaaaaattaatttagttcagaattaattttttaaaactagttcgattctgaaccagtttcaaaatcaatttgattgtttgaatacaaaattaaatcggttaaaacagtttaaaatcagttggatttttgttttttttacaaaactagtgtttttacacccctatccttgtgggagtaggcatcaaccaacaagcacacgtcattaacaacattcttcaccatttttgttcatcctctattaagagagttaggttgcctacatataaagttttgcatgcatgttctcaaataatgtgagccagcatgaaacaattgttgttaatgtgtgtatttaccaatgatataggtcaatattttgggagttcatatccttcatttcttttttaattgacagtttaaaaagtttactattgaaaagtcaaagcctcatcctttgttggcaagacaatacaattgcttaatccctcttatgagggttcccgaaaatatcatgcaaactatatatatatatatatatatatatatatatatatatatatatataagattcctataagtatctgtcaatcatgagagaacatttgtaaacttgaggagagtgcagctcttggatatagaaacgtaaaactaaaaactcttccatcgtgtcttggaaactttctcacaaatgatgaaggtaggcatagaattggatgtcttttccccatatgccatcttttgcgtgattgtgaagatgttgcagccttgcggaccagccttaatgcttctcagcaatgtagctcattctttacttcgtcggtttagatgcttgattgtccaaaatctacgaagagagtatcttatataaactataaaaagtgactcaatttaattatgttaagttaaattcgttatcgttaactgtgtgtatttggtttcatgttataaaatttattttaactttataattaatattaaatatatttttatacgtataattttatatcaaaaaatagttcaaaattaattttagatctaaatttgattataaatttaaataactttaaaaaaatttatgttagatacaaaattttgtatcgaattttatttttgacttagttttacaaaaaagactacaaatatttaaacataaattacgctatttcaaaattaatttaaccaaaattaatttttccaaacactgttcaaactcactttcttatgtgacacgtttttacgcatacggaccgacagtcattttggtccttatgatgcttaaccttaatcactttactgacatttaaatttaattattatttgttgttattttaataattaaaattaattatttattattattttgatctttaataatatttttaaaatgaatatttatttattaagagattctagttcatttaattggatagaatgtataaattattataaatcttctaacattatatttaatttatatgaataaaaaatagatatttaacctaaacttgacgttataaaattaaattttaattttatttaattaataaattttaaattgagattttagattaatttttggtgaattttataatattagatagaatttaagaatttttaaaatttttttatttttttttatgataaatcttattttatcatattagaaaaaaaaaaagaaaaaaattattattttttaaataatatatatatatatttaaaaaaatctacaaaaatctatctcttttatttagatatttaataaaaataagatgttaaacttgagatttctatagtggaatggaggaagtaggattgttgaacgaaatgatgtggtagtgaatgaaagtgggtcccagtggaaaagtgggcagtgaggcgcgaagaaggaggcgacgtagctttcagtctcacagcagacaatgtaagatttggtggttctgcgctacgtgggaccaatagaagagtgaaacgtgtcctcgatatgtaaagttgaatcaggtgttcttcagcaacagtaaaaagatgaatgccactgtaactccaatcttttccccaactcaacaaactttatgatctacactgtagagtagactagtccatagactagcttcttccatgtgtcgcacttcaacattgccacgattaacgatgcacgattccatttttttatattttatccttctttccatagaaatatatatttattcatttcgtacaattcaattcataattatatgtttaagttggttaagtttatgagacacaatttattttactctccatataatatactttttaggaaaaattatcaattttaaatttgattcaatttggattaagaattagtctcataataaattcaaatgattgaagcttataaaaatattttgaaatatcactaaaacacctaaggtcagtggtgtcaaataaaaaaaaaaatttacttcatttcattttaaattaaataaatggtgaacactaaactatatttggattcctcaaatgcattaaattaatatattggagtaaaattttctaaaaattaaaaagctaagcgtaaaaacatgtaaggaattgaaaaataagcatgtggaggattttatttttagataaattcagtacatgtttaaaaattaggtggaaaaatacttttatacaaaaggattaaaatccatatttttattcttatcttataaattatattgaaatacctataataacaatttcaattacaaaccaatgatacacttccatgactcaattgaaagtgctttagccgtacgtcttggttttttttagctaaagggaaactataaagtataaataattaatgatgtttttcttcggtgctccaaggttgaagttagatactactgttactgtaacacgcacgcacacacacaggaccacggaagtcaaatagaaattacaaaatttcgtttgaatatttgtattctttacttttataatttcaatcctttattaattcgctatttagtggatggttgcaaaccgagtctatactaaaaataaatagaaaccgacatggagactcttatacgagaagcatgataaacaataagttagttcttattctttatttgattcaaagattgcagttcacaacgggtcaaggaacctgctgatgcaaactaatgaaacattaaggtcaagtaaattagcagcattttcaagcaggaggttaaatgtcacattcacgagtgtatagtattcttctatgatttgccattaatttatacgttactaataattatttaaagagtttaatcgtgatagcataaaattgtattatattgtcactaatcacatattattgttgaaatgatatgatttttaaaataattattaaaaaagttaataaatttactatatatgttaatttgtgattaaatgtcactataaagtaattttatactattattactaattttttttactctcttatctaaaaagttttaatattctaattttctaaaattaaaatagctttataacctactatcttttgccaatcctagctagagatgcctctctcactccaaaagtaagtgtacattacatatttaaccaaaggggagcacctaatcatttttagttcactactgacattcattctaaatgttgttgctatgttgaaaaggagataaagattggttgacatctacaagggtgtgtatacacgtgctagaggtaaataaaaataaatattgtgaatgatgtgatgaaaaatacgagacataaagatatatggtatatgcaaagtttaggggtataactgtattatatataagaaaataactttgttgcaaaagaagttgattttctacaaactgctttatttccggctgtaaacacctttctcgccacatattttacaaacatttcttagtttctcagtcctcacctttccagccagaaaacgtgattgtaaatttttttttttttgttagaaggattttgaatctttttataaacatactgatgatcaaagcaaaaagagtgtgtttgtttaggtacacattgaatgagagtaaaggaaatggaaatgaaagaaatgaatatttttaacttcttgaattggatcttttggaagtgaccagttgacgattatttttttaatgaaaaaataattttcccttaaaatatttcacatggttgtttgtatcacaaataagagaatattagattaatatacttttttcttttcctccaattcaatattggaaacaacacttaattcaaaacgaaccataaatgaattaactataatttataacttttggtaatacgttctcaaatagaatacccatgattctcttcctcataatatccgatattggaatccagaaagaaattatgtaaaatgtaaagagatttattttcattcccattagacaaccatcaaatgaggtcaaacaaggaataaaattcgacataagaattttcaatgtatcaagcaaaggtagatatggtcaaatagtcaatgaaaattagatatatattccacacttgaggaaattccctagtccatgcactcgagtaacttgcatatgttcacttcataagaaaatgtagcaataaacttgaacctacaataatattttaaaagtgtgtttgaataaatttctttataagaatttattggagaagaaaatacgaaagaaaaataaattaaatttttatacaatttaaaattaatttatgcataacttaaaattcaaacatgccgtgagtaatgtttaatttaattaattactatagtattgcttaagaaaatacttttttcctcaacaggtagataatactttttagtgtagtttatagtcgtagcattgcacatatcaatctagttggaatcacgtgtgctttgatctagtttttacatgtcctctttttgcttaaaacaaatttaatcagctgaaaagaatttgttcacctttgactatgaagaaggaaaccattaatatcaataccatgaaaattacacttaaagtaccagccggcttcaaatcaccaatatgcttaccattacgaaggagtagcttgtatgcaataaactttgaataacatttcaaccaaaagtaatgaactttgaatgatatacatgtaatgtaaattgtaaccacaaacttgaagtagaatatgtgcatgatgagtagtaatagtcattgactttgaagtcctggtggggtcatggaattataaaagctcccggcggcgtcctcgatggtcaaactttgccctagaaatccaaaggcttagcaaaatcaacaacttggtcatgaccaatcttagtgaaagagaaaggcattcactgttcatggaaaagtgtcaccactgagaataatacgagtatattttgcaagtatttttgattaatctttcggcactaaaactattgatgtttaaggttaatacacatatcttaataaatatgaatagtactaagaaattttatatttagtctaaaatgcaatcatttaataatttttttgaatataattatatttttgagtaattataattttagtttaatatgtcattttcttatgtctagtatggtaaaaggaaaagtaaaagagaaagctttaaggtgtgtttggtttggtagacggaaacaacagccggacgacagaaatgggggaagggagtttggtgtgtgtgattttgatagaaattaagttccggtgtattaaattttctattcattaaacaactttataatattatttttactcttttttttaaaacaaacaacataacatattattttatttctattttttaatatctcttctattttcgtttattctatttttctcttctaaatctgagatatgaaaaaataataaacaaataaaaaaaaaagaagcaagagaaaagcacatgacgagtacaaacaaaatggagattgctaacactagagtccaactactcaacgctcttgaaaataggcccaaccaaatggtccattttaggctaagttcaacaatcaaaggggtatcccaaatagagtttataaatcaaggagaagattttcaaattaattcaatgagtaaagcacttgcaaaattcatagtgaagagaaatttaaaactgaagtagtttctataactgcttaaaagaccatcagcttataaaagaaaacctaaaatacagtcaaataaacaaaaaaacctgaaaacggaccaacggttttaaattatacattatttagttaatatatgcaataatatataacctcgtgatttcttgaatgagtcatgaatatatttacattgcgaattttttttgtaaaagaagcataagccaacattaagaaaatagcaaactgaagcaaaaactacatagattttagacattcccatccaacacacaagtatgtgtatatatatatatatatatatatatatatatatacttatggaagttttcaaatcacacttgttctttatatacctttgtatccattttcatgtcataaagtacttttttaacacgtactgtgcttaatggcaagtaaagtaaccactcctactatactaaattccttattaaaaaaggatttaccactttgcagaaaacaaacaaaacataattgcaacttgaaatatgaacaataaatattcaaataagatattaggccaaattcaactgcactggagaacagataatgcgcatccatgacctggtacttctgctgagaacatattatttgttcgtatggttcttccactccacatttcatttccagaacaaagtataaactttcttctacctggatgcactatagccaagtctattatggttgcagatattgttgttttctcgttactcagattgaaaaatgcaacataggtctcccctgaacggaagcaaaagcaacaacatggagaattagaggatagtgcactataagaaatcatggttaattaactgtgccatgttattttagttcatctcaatttggtagtaaagaaataaaggattaaattagaaaatagagaaatatcaaaccttttcttccagttgcaatccaagatcgaatccgattaggataaccttcagctgcatgattggtgaagttgcattactagataacaacataaataaattagaaatagtattaatgattctgcatagagagaactttttggtactaatttttacctagggcatgttctactattgcacacatgccagaatgaccattaactagagtcccattagatttcaacttccatatctgttcagattaaatagatgtctgctttctgcatgagcagcaatgtaatatggtttagtacaaataacaagaacatatctagacaattaaattggagaaattacgatgattacgatgatgccgtggggagttgtctcttgtgcacacagaaaggttcctcctgatcatgctttggactcttgtaacaaattctttcaagatcttggtaatatttttcactagaccatccatatgcttttggatcagtcattcagtgagagccagggagtacgtaaactgtacttttgtgacattgtgtcttttagtctttacatcatttaatcttgtgatatgaggaaactatatagcaaaaaaggcagaaataatacaaatatgagatttaagagtatgtgtgggtgtaagctcctttagaagtacttctagaagaagaaagtaagaagaaaaaaatgaaataagattctccataaactataataagttttcaattagagtatgttttgataaagtattttaaaatttcaagatatttaaaattcagaaaaattaaaatgcatcaattaaaattcttttatttttaaaattttgtgtttaaataaagaaattaaatttcttcattttcaaaattttgtgtttcgataaaaaaattgaatttcttcatttttaaaattttgaatctcatgcacggagagacgcgtgagatgggtgtcgtgggagtagcggaggtcgaagtactcgccggcaatggagacggagcaaagagtggtatgattagagcttctatagaagaagataatttcaaaattaaagaattttaaattctctgataaattacttttcctaattaaaattctctatctaaacacactcttagttaatttgtagatgtcatctcatcttttagagaaactatattggtaagcttctaaaaattagctaatggaaaacttaattttgcttatgaaaaatttatcttattttttttcttcttatttttttcttctagaagtacttatagagaagtttacccgaagagaccctacctaacatatggttaccaaaagtaaaagcaaatggttaccaaaagaaaaagcaagtagaaagagaagtttcacatgcctcttgattatttgagctaaaagagtttatctccaatacggtaggatttgtgataagatcataggtccatgcatcaatcaaccgtagatcccctccatacataatgggagactttgccttacaccacaaagtcatctatgagatgagagtaacttcacttagaatctattaatttacatgggtatatgtcctctccaatttatagtaatgcaattcagttgtgtgtttgtgcatcagtgcatatgtacctgagttctttgctcatcttgagtaagcctagtaatcctgtatgaaccttcatgaacatctgtcgagaaaaaaaaaccagaaaaaaacataaaaataaagttttattctttatattcctaaacatctcaaattcaaacaaactcgttgcaattatgtatatgcacgatgtatagggatgaaactgaaaaaatatttttcttttttctaatgatttagaaagtaaaaggcatattttttttggtgaaaaaaaatagggaatatggtggctactctattcagtgactaaagcaacacaaatcaaacataaattaaaacattagaagcaaagtgttctgaaccttacctactgaaccaaccccattggaactcggtagtaaaatggcatattttttaaaagtattatgcattggatgtaaattgggaactgtttagaataccttaactatcttggtcctaataaattaaggaaaaaagtagtaatgcaggggcatttaggctaacctggatcagttagccatccaaatggtagcatgtcgaaatcaggtcaagattttccctttaaaccttttcctcctattaaattagatgcagcgaaatctctgaaagagtgaaagacaaatcagagatgtagataatttgaaggtagagtagcagaagaaaggtggaagggcactccacatattttgatatcaaacataggaaggatttaattaatgaccttactatattaaaatgagctaaaattgctgaccattcatcccaatcatctcctgttaccggtatgtgttaactagattactaaccatcttagccatttgtggtgttgcactgactccaggagacagagaaagtacaatgggtttgttaagtccatcgagaatctgcatagatggtaactcaaatgatgactaagttttccatgtattacctttaaaatgaaaaggacagaaaggggtgtgaattttgcagtaaacctctgatacagatgttatttcacccaaatccaagttattaccaaatacacagtcaagtttcaatgtaagaaatcaaagcagaaaatttataaaaatgtgtcaaagctggaagtaaaatatacccacaattgcttattgcttatttaaaaacattatgattgaggtctaatgtaagaaatgaatgtattgcatattttgcaatagtagatgataagaagaatatacattagtagtgtgaataccaaaatcaactccccatgaagcataaagctcatagattgatcttaagaaggcttttcgagctcctgtttttgtatttatagccatgaaaccgttactcatccatttacaagcccttgatgggattcctatgtctcttgctttccagactcgaccagattccatgtaaggttgtccgtagcaaggtgcaagaacagaaaaataagttcaagaaaaaataacgggtatgcagtacaccaatagcctctattttcgagcaaatatatgcatttccttgcttcttatctatagccaaatccttccaaggcccaaacctccatttcgcctacccgttgtcctccctgcttggcccttcataataaactcactttacagcatgattactcttattattttttcttcttctggtaattattttttgagttaccgttatttatgtaaagtatccatccgctttatagatgattaacttctgtcgttaacctattgaccaacttatgtgaaatatctttttaagcatgtttttttcaccaataagattcaatccccaaccttgcttgaaggatctaacaacatgttacttgtaatacattttttaactatataaatttcacctttattttttatcaaactatattgaaggaattagaaaatgtaccgtttgtgtatcaagtattggtgtgttgttattgaatgcctgtgtactgattccagccataagatgaatcccaaacttcaaacccgtactatgtactttattacctacatcagtgaaccctctccctcctcttgaagaaggccatctttcagggtcagggagcattcgtccccatttatcaatcacatcaaaaccaagagaatttctatcaccctttagactccaataccagaggtaatccacaacagcatactgcattgtttcaaaggaaatattttatatatatgcatatatttaattactaacatattcaatagcagtagtccaatacagtacctgatatccgtgagcaagtaaccactgagaaaatatattacattctgtaagtattcttcttcagaaattatccagttaaagctatcataggagttccagcctcttggaggcatgatagcatttaatgatgacacactgatatcaacaatcatgatgcatagttgaatatataccaataaatttcgtaaaaaggatcttacgaaatagatatgaagactcagaaataacatcatggttggtcagtgtttacgtatgtgtaattcctctcatgactaatgagtaatgataatgaatgaccaaataacagaacaaggttgcaacataaaaagtggtgtccaaaagatcatggaactctctttttagtttatttaagatttaagacgacggattaatattttttttttcctactctaattaatagtcatatttttcaataaaatgccgtgaactaacaaactaattaaacaaagagagattcctatatctagctaattacttttttcttcatatataatgtttatttttaatttgatctctgcaaaaaaatggtctatatgtatataattattttcaattccatcgtcaccagttgttattataacattgctagattggtatggaaatataagaagcgaattttttataacatttatttttattttagttataatactttgttgcgttttaaccccaatacaaggtgttttgaaaatggttgtatgcatgtgagtgtgtgtgtactactaaacagataataaacttgtctaaacgaagaacatgagaaaataaaatgattcctttagtaggaaaatatattttattttcatttctattttttttattaagaagtataagagacgtgtcattttattttttattttaaaagatttattcaaaaattaatcataattgatttctgtcgcttcttttacaaatttaaatttaaaaaagtaatcttttcataattatcaataaaaaaatctcaaattgaccggagcctaatttttttcccttgtcattacataagataaaagaaatagttaaaataaactgattaattaagttcctctgtatagaacaaaaacaacaataagttttttttttcttttccgataaacaaaaaatagtaagaataaacagattaagtcctcctcattataaaacaaaaacaaacttgttcaaaactaaacatacccattattgcaatgtttttttctctgtcttcaagaaaacatatatgtagctgaaaatcaattattgaaaccaaaagcaagagaatatgatgctgaaataccttcgaattgcacaaagacaaagaaggaagcaaacagaggtaactgagatgcacttcatggttgcagctaactctattccaatcatcaattatgattcttaacaggggattctagtatatataaacattgcctttgcctttgtgcaagctaaataaaagttcatgttccttatttgattcataacgagtttgtactagttgcgggccccgactcacatacaccattctacattttgagtaacgaaggaagcatcaagtctatcttgattcaaactagaggacatgtaattttttttaatagacagatcataaaattttagctatttttttttataaatacgcatgcatgataagactaaggaagtgaatcaatgagccttaatttctttatccccaccttaatatatatggaaattttatgcgacaagagaattgcattagttatgctttggatcactcaagataaagaaattagaaggtgttggcaaatttaaatgaacaacgactttccacctttgattcgttaattcggattactctccactgaaaattacttagtatcaattctattatttgaaaaattaaaaaatgacattttatgtaatgagttctgctatatggtacgaaatcttaaagcacgaaatgcacgaaacactgaaaacagatcatgtgtaattatcttataagaaaataaattaaaatgttcaaaaattaagtaaaactgaaacagatacatcgtttataactaaatcccgttaatcctgaaaattaccgcaccaaatttgaaataaacaaaagtcaaataataattgctccaccgaaattcaagttgtgaacgtgttgcaacaagaaggcttacatgttgtaaaggttattgggtttaaacgtgttgtgcctttgatatcaaaatggctaattatcttcaaaaataaaataaaattggtgcaatgcttatctttgatttggatagtagtacatttgatgtcttgatattaacaaccgctgagacgtttggaattaaaatcatagaaaaaatgaagtccatgtccttcatgtgtttagtacgaatttttattcgtactcaacaacattttccttatgtaatactgtatataattgtttttcctacatatttttcattttttatacagacatctcaaaattagaatacactcaaaataaaaaggaattgcattttttttaaaaaatagattgattaaatataacgactacaatttcttgcccataatagatcacttatcactgtggtcttatctattttcttatttgttttgaaaaagagtttgtttgcatatattagaattgtttttaagagtttatctgtttaaacaaaaattttattttcaataaaaaaaactcttgatttatattcaaaagctttgattatctctcctcaactctcttatcatgcctagacaactgttcaccatcgctgatcaccgttggccgctgtctcctcaactctgcatgacatatgaaaatagaataaaaatcccaaaccattaaaaccactgccaccattcctcccccaccctctcccaccaccaaatcagacccatccatcaaaatgacaccacgacaattcacaaactaaaaagaaaaacaaaacattcgtcgatggaaacccagcaaacagaacagtgggagtcgatttaccttgccatcgttcgcaatcgacgatgattatagtgaagggagacggaaaaaggaagaagaccgggagagggagtcgtcatggagatggagcagcgatggtaacatatccgggaatgtcactgatggttgggagaacatatttggggaggaaccgaggaagagaggggatgaacagaaagaaagaaaaagaaaaggagaacaaaatgtaaaaatcttttatattgatagcgtaaacttttttctttaattcattttttcataccattgtttaattatataaataaaaatttatattttttttttaaaaaaattatagctaaggcaagtttgaagttttaattatttgctaatttaagtatctttatataatcaatatattaaaattaaattcattttcttttataacataaaatacacacagcaatatgtctttttctacaaatcaaagatggtttgcctgacttttggattaacattattaataactcaaaccaacccacaaaatgtcatatatacctatccaaaattaatgaaagatattttagaaaagacgagtttgatatttcctttgttcttatgcctttatgcatgaatgctagccatttttataatgtcaacttttaattgattataggtattaatatattttattaaaatatttactatatttttaacgtaataaatattttttaaaaatcaatcctaatatttaaaaggtaaaatacagaataataaaaaatgaacttcattgtttcatggattaaaaaattgatctcgaaaatgtagtattttatgttttttttttaagtttttaaaaaaatatttttcggatattgtttatttctaagaaagtagttataacatgattttgtttcatttttatttctatgtttaatttttgttaaaaatttattattacatgcaaaatattcattaattttattaataattaataaatttaacttatcacttttaatacttatattttcttaacaacattttttccatctgaaaaattcaaattcagaaatttatttagaaaatacaatttggctaaacaaataaatgttcaatatgttacctaacgtgtgaatcaattaatgtaaattgatttaacttaatcaataattttacaacaattatactaactgtattaaatatttaatagaagaactttaacactggtaatactaataattgtgtgaaagtttgaacagccatacctcttgtttagaagtatagctttaacacatatattatatagcaatttttccaagtttaaatgggattgtcttggtaaattatacgtgtgatttgtaacaaaaatatataaaaaaaaatgttaatattcattgacactagaggttggtgttgtgtgacgtggcttatagcatcatgctgcaagagtatcagtcacgtggagttctctcgccctcccatcacttcagtcgtgggccccacgctctttctccctccctcaaatctcaaagaggaagagccacacgctgtgccccttctctctctccaaaatcccaaaaccgaagcaaaaaccgccttcacattcacaaccacacctccgcgatataaaaaagaataaaaaaaaggtaacctccctcagtccctcgctcatggaagagctctccgcggggcctctcgtccccgccgtcgtgaaaccggaagcgtccaaaggcgccgcccccgacacagacgcttccgccgcggcctccggcggcatgttcccggcctccgcgtcggagccggacaaggacttcctctgcccgatttgcatgcagatcatcaaggacgcgttcctcaccgcgtgcggccacagcttctgctacatgtgcatcatcacgcacctccgcaacaagagcgattgcccttgctgcggccactacctcaccaacaccaacctcttccctaacttcttgctcgacaaggttcgccttcctttgctctcatcatcatcatctccatttattttactattccacaatgctccttttgcagtaaaacttgaattcagttcttgcttctgaatttttcgtaaacgctgcgtttaagagaacagtcgtttagtttttttggaatgtatgtagcgaatgaatgctgtttcgattctctagatctttgttttcgcactgtaattagtaactgctccttcttgcaatgttgctgacttaaacgtcatagtttttagagtgtgtgctttgctctaatagttcttatgcgattccgcaatgctcgttttgcagtaaaacatgaattcaattttcacttgcgagttttgtttagtttttgtggagtgtgtgtggcgtatgaatgctgtttcgagtctctagatctttcttttggcactcgtaattactaattgctccttgcaatgctgctgacttaaatgtagtaggttttagtgagagattcgagcatgatttttatcttcgaaatgcagcttattgttatacggtttctgtatcacatttgtagctactgaagaagacttctgtgcgtcaaatatcaaaaaccgcttcacctttggaacatttccggcaggcattgcaaaaggttggttgtgctctcgctttctcttgattaaaatttgtctattggtagccatgttaattgtgcaatagtaagaggtctttgttgcatcttactttttatgttctgttatattatgaatataagtctagaggaaagtttatagtatgtttataaatttcttttttggactatctaataacatagtagcatatggaagaggattagagggtagctggagctggttttaacattcgttatgttatacaattcttgcatattaattgtatacgccactagatcaaggaccaaagtatcggttttaactcttgtcattttattgtctaatattatattttatgtaagggttttaatcaagttgtggattcagttgtatattggttttagtggaattcatactactttagtatattgaggatcactctattgtcacatatttccgtttcacgtgaaactgtggatctgtgttgactgttgatgctatttagtctgtgattcctttttctgtttttaatgttttgagttttggtacagggttgtgatgtgtcaattaaggagctagacacccttttgtcacttcttgccgagaagaaaagaaaaatggaacaagaagaagctgagagaaatatgcaaatattgttagacttcttgcattgcttacgcaagcaaaaagttgatgatttgaaggaggtgtgcttgctgcaatctctctctccctctactctaaactattgctaagtagctaatgtttcccttttttttttctttcctctgtttgcagtagttggtcattatttactactgatttccatattacatttatttttacttattgcaacaattggtgtttcatactttcatttgtaggtacaaactgatcttcagtttgtaaaagaggacattaatgctgtggagaaacatagaatggatttgtatcgtgcacgggacaggtactctgtaaaattacggatgcttgatgattctggtggaagaaaatcatggcattcatcaatggacaagaacaacagtggccttatatctagccctctaaatcttcgtggagggttgtcatcaggaagtcatactaagaaaaatgatggaaagtcccaaattagctctcacgggcatggagttcagagaagggatgccatcactggatccgattcacaatatataaatcaatcgggtctttctctagttagaaagaagagggtgcatacacaggttttcttggtttaaatttccatgtttgaaattttatatttctattttatttctaagtgaattggtttggaaattttaatttctttttggaaaagctttttgccatagaagataattttgtttcatgccaggaaaagcaattgtagttctggaataagtttaaaaatttctacttaggaatttttctaaaaattgaaattaatttatattttttagggaatccttatttatacctgcataagtagttctgcactttttcatacactaatccctttcaattgtgcatttaatacttttgaagtattaccggttaatcaacacattttgagctaagacacttccttttttatttatttattttgtggtcattttatgttgccacaagcttcaggattcatgtggctatagcacatcttaggagagacttagacttaaatcccaagctaaaataagttagtggacataagaaaaggtagaaaatcctggttttttaattttttaagctgtatgttaggtagtgatttgggatggctgtggacagcaactttattgtttgagcaaaggcaaggaaaaatataaaaatgaatagtctaaaaaaacatgtatgtgacattatacacaaaagtagttaccactatatcaacacagctgtgtactcaccatagtatgtatgtatgtaatcactaatatctgacattattaagaaaagtagttactactgtattaacaaaagatatctaaccctatcctagggtttcagtgcttcttgctttttgaatctctctttgaagttctttcatctctccttgaatcctgttgtccctcctttgaatcttgcggttctttttttcaaggagggacaaaaggatttcaaggagagatacaaggatttcaaagagagatgaaacgattcaaaagttgcaggaggcactggaaccctgagttagggttagttttcttttgttaatacagtgataactacttttcttaataatgtcagatattaatgatttcatacatactgtggtgagtacatagctgtgttgatacagtggtaactaattttgtgtataatgttagatacatgtttctttagaaacacttctaaaagaagaagaaaaaaatgaaatgagctttttcttaagctaaaattagcaaatttgtagaagatctctcatatagcttctctaaaagatgaaatgatatctacaaattagctaacagttatctaatggagagctaattttagcttatgcagaagttcattttttttcttctcctagaagtgcttctagagaagcttacccaaataggcccattgaggcaagctaaatgtgttatgaaattctcattgagttgtgtatttaatacattaaggacattgtctctttaaaacccttgcaggcttagtttctgccactataattaaaattaactaattaagacacaaatatcaatatatcataataaaatttcttgtgacccaaagttacaattgaatccctattagaatgaatatcttatcaatcatagaaactactaattaaccatgaaacaaaaaatgccttaaaaaaattagctgagtagcagatgccatattgcttatgaaaaacaagacttgtatcaaaactagattctgtttttttatttttctttgtttttatggtttatttattattgtcttgtaacttaagtctgaattttgtaaagaaattttggcatatgccatatgctggcttttattttttctgtcactgagtttgcatctataaacttggtttattttgtcctctctgactcctgtttgattcccttcctttgctccagttcaatgacctacaagaatgttacctacaaaagcgacgacatgcggctgataggccccatagccaacaagaaagagatataaatctcataagtcgagaaggttatactgctggtcttgaagattttcagtcagtcttggcaactttcacacgctacaggtatagttgtcagtctttttctgtcatttcaaatatccattcaaatatttttaggacatgggggtattttcccggaagaatgaatgggagtcaaattagctaggaaccgttacactgtatgaggaggttcaattagatgaataggggaaaataaggtcgaaaggaggcatttaggaaattgtattttatattaactgagcaagctctccttgctctgttcaattatagtctataaataatcattcttttcttttatccctttccattgggattcttaacagagttacaggtaatagtgtcagttattatttttttgagtaagcaatatacagttatctctaaccttttttcttcatttgaaacagccgattgagagtcattgcagaactaagacatggggatatatttcattcagcaaatatagtgtcaaggtgagtttgttgaaattgctcataacaattggtattcatctcttgcattttgatgttttttatcatagttatttttataaaaaaactaatcaatgtttttgttccaacctatcgtcagttacattatggttggcataactcatagagccatgctatgggtgaataatggtatttttataatttagtattttagttggtaatctgtgacttcgcaatattataataatgatgattgctttgattctaatagttgggatgaaaggtttttactttattttattgaatattgatacggtttggatgcaaagggattttaacatatatttacacacagggttgtgattaacttgaatagtttatgttcttcatcatcattttcagtttgccattgtgcccccaataaaatctagtgttgttaagatgcttaattagctgaatagtttctcaatacacaaatcaagactctttgtgcaaaatcccttgaagatcagtacaccaacatccctactatgacttgtctgcctgtctagatacaagttttagtggaacagttaaaacaatgggtttgctatttcctgaatgaaattatatttatgttcttggtgtgcaatattccagatgtagtttgtgtcatgggtatttgttcaaatcttttgacgtaaaatttagtctataatggccttgttaccatattgatgtttataaagttttaggtcttgatctactggtacagtgttagaacagttacatatggatcatgttggtacgaaattcctgttcatatatgtacacattttattctagagatacattatgtggaaataatgtactaggtactttgacatgacggacaagtttttatttagtaagttgatatcctttttcttgatactattgttttaatatgaagaagttagacagagtaagctgtatcattgaattaaagtggtcatgtcacatttatattttagtatttaaattttccgaattcgtggatttaacatgtatattgcactttgcagcatagagtttgaccgagatgatgatttctttgctactgctggagtttcccggcgcatcaaagtttttgacttttctgctgtaagatggatgaccttttacttctattactacttttaatatcattttttatttcttctcttttgattgttaacatttttgtaatactgtgctttttatagattctgtcaatgagtgtttcatctattccttaggcactcatagttcacttagaataaaatatattactcgtatgaattacaaactatgaatacgagagttgcactggtgctattactttcataccaactcaaccaatttatcttctttaattcaactacaaaaactggttcacaggaaaaactttagtcttattatttgacagaacatattagtaatccttcagggggtatatgaattatatgataaaataaaaacatgtaatattcaaaatagaagcatgtaatatgtgatttacttcaatctccttggaaatatttggaattatttgatttacggcatttctggttaaatttgttttgtattataagtgcacctgcacaacttaaatgagaaatttgctgcactatatataatatgatgtttgaaggatggtgtatttaaagctagtcataaagcacatttgctggaggatttgctattaaaattagtgcaagggttcaccctttaaatgttgcttaaactaatagtaatacattatgaaatatgaatacaaaataaccattcccaatgtttatactttccaggttgtgaatgaacctacagatgctcactgtcctgttgtggagatgtctacacgttcaaaacttagttgcttgagttggaataaatatgctaagaatcaaatagctagtagtgattatgaaggaattgtgactgtttgggatgtaaccactcggaaggtaaatgttgaattcaaatggtcagtttgttcttgtatcagctctttgggtatattatttcattaatattgttttgaatgtcatgtgcttgcttaaattttctacagattatttactcctggctatcatttttcctttcgcagagtttaatggaatatgaagagcatgaaaagcgtgcatggagtgttgatttttcaggaacagatccctctatgcttgtatctggtagcgatgactgtaaggtactctgaaacatttatttggaagttttttctgccagtttccctaaaatgcttctgtaatttctaatatttttgaaatgaaaatcatgcttaacatctgaattattatgtattagataaacttaaccttttgttgtataatcctattcatagttatagattttgccacctttggcattttggttagtcaaattcaaattttcttggcatggtatcttctgttgtatgattgaaagttattgatgtaaatgtaatgtctcttttctttgagcaggtcaaaatttggtgtacaaatcaggaagctagtgttctaaatatagacatgaaagcaaacatatgttgtgtcaaatataatcctggatctggcaattatattgcagtaagtacctttcattcagtcaaaacttagatttgatcctatccaggtattatcttgtgtcgatcattcagcttagctgccaacttgtgacattgcttggcatttcgaagcaatatactttatatttaatttattataatatttcctcaggaaacagttcttttgtaatagtttgtgctgattgtacctaatagttaatatgaatggtgatattcacatgattgggtttcctgtctgcccatatattgtcttctgtaatatcgaccacccatcttccttatctgttttaatttttatatatctaatatgtacattctttgcatatttttgcaggttgggtcagcagaccatcacatccattattatgatttgagaaatattagccgtccagtccatgtttttagtgggcacaggaaggctgtttcatatgtgaaatttctgtctaattatgaacttgcttctgcatcaacagatagtacactgcgattatgggatgtgaaggaaaacttaccagtgagtaatatgaacaaaatgattgtttgctattgattgattcttatcacatttatccttcattttccatttaatttgtggacccatgttggcttttgttaatttaactataaccaataattttatactgaaaatctaaatattgacaattctctaatttctcatcgcaccaatattatgtttatttatggcatgcttgatgctcctgagtaccacttccttttgaattcaattaatttgcaaaacattcaaaatgcactacaaaattgattttgaagtgtgtaaagtggaccaaagctatccaaaacctttgtaaatatttaaatttgataatattttttgtactttctaaaataaaaatatatatatatatatggaatataaatataattttttctcattttcattctaatgtgtacaggttcgtactttcaaaggccatgcaaatgagaaaaactttgttggccttacagtaagcagtgaatatattgcgtgtggcagtgaaacaaatgaagtctttgtttaccacaaggtttgtggttttcaatcatgtgtcgttttcttgggcatttgccttttatggtactgaggattcaattgcccttttcaggaaatctcgagacctttgacttgccacagatttgggtcccctgatatggacgacgctgaagatgaggctggatcatacttcattagtgctgtatgctggaagagtgatcgccccactattctaactgcaaatagtcaaggcaccatcaaagtgctggtgcttgcagcttgaacactagaaaaaagaatagaatgtggaattggtattatcttttcccatgctattatgattgtatcatttattaattgtacatagtattcaggtgtatatggcaggctttagagatcttaatgaaatgttagttgagtgcttaaacctttatcaacaaaccaatttaagggactgaactataatttttgcccattgaggacctcaaatttattaaattttgaattaataaatgctcaagagacaaaataaaatatcaaatttggcatgtgataataataataagggtaaataattatttttgtctctgaaatgcagagcgttgacaaattcatttctgaaagatgaaaattcaaattttagtctcaaaaaagtatgataaatttatttattaattaatttttatttattatcattaatgaaaaagtctacatggtacaaaggaataaaattatcacaaaaatgattatcaacatgattgttcaatagattgaatccaaatgtcaataagtttttattgaattaatttgtcaaattttaaattttatttcatttaaggataaaatataatttaatctttattttttctccttttttatcgttggaagtataatattataataagtatttaaaaaaataggaaaataaacataagttagaataaacataatattaattaataagcataatttgtctattgctctaaattttttaatgtgataatattttattcaaaatatgagactaaaataaaaatgtacagtcattaagttgatttttacaaaaatgagactcaatttcattttttcactacctaatgatgtctcaatagaaatttcaaaacaaacaaatactgcttattaatcaatattatgcttattattatgtttgttttaattaatgcttattttcctattttttaagtgtttattgtaatgttatacataaataaaaggaagataaagattaaattatattttactcttgaatgaaacaaaatttggggtttcacaaattagtctaaagaaaatttattgacattttgatccaatggaaatttattgacattttgatccaatctattcaatcgtcatgttggcaatcatttttttgacattttcatccttctgtgtcactatattctttcattaatcatatcgaacgaaaaatgacatatgaatgaatttgtcgtactttttttcatttttgaggactagaatttgaagaatttgaatttccatcttctggaaacgaatttgtaaacgttctacacatttaagaataaaatgactatttaccctaataataatatcaacaaagcacctagtatatatgatttgactttttaaatacataattatgattgttactattatgttaaaattgaggtcctcaattgatattgaagtaagttaaggttcttaatataaatattaaaatcttcgttaattggttataacattatagttgaggtccttcgattacaaacttgtagatattactcttcatattgtcattaccaaggaaacacatgtattaaattttgatcattggttgtttcggaaagaagaaaaaaaaaaaaaaaaacatgttttgttctgctccttgactgtcatctttgctaaattgagagaaataaaaaccagttgttcatacatcgatgcatattttcattatctgattatggtctcattaaataatgattttgtcatatactcgcctgtggggggatggatatttcgcataaaagtattttttggaatatgaaactttatagaggacaattatgggcatacatttatctctgtagatttgttgcagagggatcagtttttttttttttttttttacattcgcttgttatcatatctgccttaatcagtagctgagagcctggggagaccatgtacatgatgatgactatagtaagggtgacgcataaaactcactttcttgttttctcttggagttgtaatattctcaaaattccccattagcaccattgcaaattctataccgaataaccgagtccatgtgtatatactatatagagattcatttgtcaaacaatttggtttggctggattaaaaataaaaaagggttcgaaataatcagttaatgtttttgtttattgcttcataggttttcacttgagcctgattaacaacaaaatacatgtagccgcatactaatcattaaaacgcgcataaagcacaatacagatagaacatttacaatttaaaaatcatctgaggatctttttattttattgttaaaaatggatgttattcaagtatttgctagacacctgatatttgcagggactcacaatctttcagattcagcgaaaataagctatttcttaatcttattaacatttttacttgaaacttgcataaacagttgatatttgttgtttactgcaactaagtggaagagtcactaaatttattattctgcataaagttaaaattttgggcatattattcttgaatacgtttctaataaaatgagtttctttctggagtaaaagtatatttatcactaatttaaaatagataataattgtaatttattaaaacataaacataaatgtcgttacttatttattttaaagtttaaatatgaactcgctatacgaagctcttccaatattcctctcttctcaagatactttaccaactcaaaacacttataatgttcatatatttttcttcaattaatattattttttcctctacatatttgtatcaaattgcttattttacatttctctctctttcttctttctatctctcacgattgtaattcttttttattattttactatataaatatgatttcttcccaaaaaaaatggtggagcatatggtcggaaaagttcaaacaagtttgatcactaattttgttacacagtgattacttgagcattttttgttagatacttgaacattagtttaacatatatttaaagttaataatcggtattattccaaaatcttaaaatttagctaatgctctttttactataagaaaaaaagctaatacttttgaaaatattcttgaccttttttctcgacacacttttatttatttctttttgcgctggaaagtggaaacacactttttccatttaatttcttttttcccctgaccttggtattaacaagaatcgtatttcttgaagttccaagatgaaggttggtaatccatcccttctaggttttagtgtacattacattccacatcagtgttggggaaaaactaacgggatctgtgtcaaagctactaaaagagacaaatatatgatgtcataagtcattccttatcttcactaactccatcttcaaaaggatgaatacattcattgtaaaaaaagcattacatatgcatagaagataaatgaactatgaagttttatagatgaggaataattttaaatatctaaatttttagaaactttaactactttattacatattatatttttataaataatttacaagaaatcttcacccaagtactaaatttttggacttgcaaggtcaagaaaacttgaacattatttataaaattaaaaaaaataaaacaaaaacataagaagaataagctcaggagagataccgccataacatctaccacactttcctttcattttgaattttgtggccttcaccttgaggggtcatgacaaagagcaccaaggtcatttcctgcaacaaacaggacatgatgaaaaccctaagaatggttgagatgagggagggtttcttcagattaaattcagctcagcttgaacagtggtatgagatgtgggagtgaggggaggtatatataatgaaaaactcaccagtgtcagcatggtccatataaattataataataaaaaatggggagggaaggaaaaaaaaaaaatcaaaatgcaataaaagacatgaaatacagaggcagtgaatataaatgatgattacctgcacgtaaaattagggttgatgtgtccctttctagcaagggtgagacaggaaggataatgagagtttgttttcttgggattcaaaaaatgaacccactattcctgcttgctcttaaattgtgatgtcaggttctgctgacattctcttgcattgctaccaaactgcaaaatatttttgttttcattttgaaccgtgaattgattctttgggtctttaattttgtactatcaggtccacttcgttgtaccatattccatttgcttcttagctagctacctacaacttaattttccatatttctatcttttatcttcatgtgtatatcctattcctactatgtatcatagggtttcaaaattatatatattatataccaacatgcatgtttggttgcagtcgttagcaaactgcatgcactcggtttagttttcattaatgtagtaacttagttcattaccaagcaatttaagatttaaaattacaaaaacaatattttaattcttataattattaaatgttagttattttagtcatcatttttgttattttaggaataaagtgatcgttgttgaatattttcaaaattaaaatgatatttttagaattttaaaactaagttaatcggtttttctaattttatgtatggaccaatcaatatatcattctcttagttttaggcttatggaaggcatactcatttattcatgaatcgtattgtttctaaattgcttcctagttgtggaaggtgtgagacggtaaattattaaatatgaagaagatatattaattaaatatataggttctagagacaaacgaatgaaggaaggaaatcggaattttaaataatagagtaaattacatttttaaaagatgtttaaattgcatttcgtcctttcctttttaatttaaaatatataatattcccccttgtaaaataaatataagttatgtttaagtttatttaaatataaaattaacttttaaaggttttctctcttctctctcttactgtggtgtcaatatgattgatagttaattttaaacatctattatcggttttgggactatatatagaagatgaaaggctttagatgaaatttcaaagccaacaaagattaaaaaaaatatatattttaccttcagaaatacattaaagtcaataacaattattcaatattagtttttcataacactggaaattaaaaagaaaagataaaacattatttggaggtacatttataattgttctcattgctctgaggttcaaaaaaaaaaaaaacatgtattaaaggatgacaaaagaaatttatactgagcagtgagcacttgcagatatccgacaaataaaactcgttgtgtatcaagtttggatcttttcaacaagtacttgtaggtgaaatgaacttaaataaataactaaatctatattaacttataaacagggcggatattagggtatacacatagcagctgcaagcctgcaagtacctatataataaatggtattactaaattatcctacctatataaatatatttgtcctaattttgtttgtttcatcctcattactttacatgtatgtgaaatttgttgcattgatattttttttcccttccaattaagtatactaaacttagacaaaatgtattcgaaatatcatttttagattttttatttttcaacatttacaaatacttatgtgtatatatgtagatatatgccaaatctaatggatattcaggaatatatatatatatatatatatatatatatatatatatataaaagattagtcgaacgattaagaaataagaaaagaagagaaaattatagatttaatcctttgttaacaaaaattaacaattaatatttgtaaataagtttttttaaatacccacatgccaaatgccagagataccgtacaataaatacgcgtatagagatatagtgaactgttattcacaagaacaaatagaatgtagtaaccactaatcttactacctcattctatctactgacattcttacactcatttatctctcaaatatatatatatatatatatatatatatatatatatatatatatatataaaatagtaatttcgtgatcagtacaataaataataattgaaacattttttggtacatacaaatttagagagaggggatgaatcaaatggtgtctcagtgtaagtcagataaagtcttcaaactcataatatttaaaaaaatacttaatttaatttgttcatctcaagaaaacgagtgagaacttgaccacacaacctatcatctaaacatttttgtcgtttttttttagtatacaatgatagcattaacaatcgaacataagttatcatgcatttacgtatccctaccattaagtcaattctaatggttctatcgtctcaattttatcaataatgaatttctataaaaaaatctaattaattatctttagatggatttatttcctcaacaaattaaggtcgaaaattagtccaactgagccaactgttaatatttaaatcaactcgaagctagacatgaacttttttttagttcaaactcgattcggttcaagtttgcgaacaactcggttaaactcatttgctcgaattacatgaatcaaaagtaaaaaaatttaaatcttatatatttcaaaagtttaattaattagtagattttaaaaaaaatgattgtttaattcaaaaaaaataaaacttattttattaactttgtagggtcacaaggtaagaccaaaaaaatataattacaacaaaagtttacataaataaaaactatttcaccatgcatatataaaataataaaaaactcaattaattaattaattaaaatatatatatagtcgtttcataaaacaactcaaatttaacttatttatttaaccaattgattattaaattgagttttaaattatttttgaactacttcagttcatttttaccactactttcaagcatgttttttctacttacactcaaacctgatatattgtgaagaataacaagtttttaagatattaattaagaaattaataaatacaaattcttatataatatgaatatgaataacttaaccgtcaatataatatgcttctaaattaaaaattaatattcaatcaacaccagtgaataactgttagctgacagaagagaccataattattgaagttattgaaacatgagacatttggatgatattcttgacttttactcctcttgaaggtttttagccattccttattcgtcaaacatctgcatatcaatccaagaaacattcacttttatgggatgttctaccatgctgattttttacctgctgggagatcacaagcttttatttccatccattaggtttttagtcattccttagtctttctttttattttcggcataagaactcagcttttttaattgaagaaacaaattctaggaccttctatcctgtggataatatagaatcaactcaatcaagactcacttatttcatgtttattaggggagcactaatttacatgactcacacaaattcataaagataaacgtgacattttttttacgtgcagttaaaaataaatatattacagtattattttttctttcttttttacggtagcgttcacttattcttttttctttttagacaaaatatttatatattatttatttattattactaatagtattttccttatataaaccgttattctaaagtctataaataattaaatttacaatattttattagtctttcttttatattatataactttattatagattatttgagaattaaaaattatttcttttcttgtctttattttttaggcattgatttggatgcttcaacgtgtttttgagtttgagtgtatccaaacacgttattattatgtaaatctttgaagaagcaaataaatattgggttacactgtagatatatcaagatttacttaattttagtgagactattgtcatgatacgacattttatttctaattttgaacaatttgaaagtacattatttttatggttctaggctactattatccgatgagtaacaaaattcattataatttaatatttttttacaaaataattaacaggatttttttttataaaaaaaaggatcaacgtaaataccaaattttattataaatacataaataggtgatcaatatttataatcttaaaaaatcatttaatttatctaatgatatcaatgatttatatttctattcgcacgtagtcaaggaccacctatgtcttctaatctaatgaattagagattaatcttctttggttgttgttggatcaagaaaattttaaacactataagatttgaaaatgagtttttatgtcaaataaattattcctcttatgtgaatacaatgaatccttacaccattacgttaatcatatgagttactaatgatcgatattttgtaacgttttggtaaattattattataattaccattttggatatcttacatgaaatttgaatgatatatatttatttatttaaataaattcgatagatgaaatatcaaatacaataattttaaaattatataaaattttgaatacttatctacttactacaaaattttgtttcccaaaattggtagttacaatagtttcaaaataaatcatatattttaaactaagattttgatcagtttttatatactttttatcagtgacgttaactaagattattagttatataaaattaaaatcatttaaaattaagatgacaaaaacattgaaattggatggggccacatgcatttgatgttcaatgccatcaagtggctatgtaattgggcattgctgcaaatgaaaagattggcacatacatagcagattgcagcagcactggagaatgcataacttgttgggtttttggttccctaccattctgattgacagagaaagaacataaacaaaaccctatgaacttagctacaaagggatcttccccaccagtcctactttactgaatgttgcttttgtccctatgcctgcaacttccaaattcacataaaagcaaaccccaaagccctaattctcacgtcttatgtaataactctacattgcagtctcataattgacccctgcactgcagtgtaaggtcaatctcagatggggtttctcattaaatgccccccttcacattgaaactaataaagtgctcacatttctgaacacaactaacaacaaagacatgaccaaaatggaactaaatgcaagtcatggtaaaagcaagttaaaacttttaactggccaagggaacctacttactatatagctagtagtgtgcccttcagtgatatattttatatacattattattatacatatatttttttataaaaaagaaaaacgtaaacaagtactattattaatttataaactatatattgtaattggttatgttatttgaatgaataataaaagcagtgtattgtgttgttggtgcttggggaccagcaaaatgtttaccatggctgtagtactgagacactgaacaattttggatttctggagtggtgtctgaaacattgtggggtattttaattcccaaactgagtgctctaactgaccaccttttactgcctgattccacaacctcgtgaagtcatcatgaaattttaacgccttgctaggtcaaccctgaattagttttccgtatcaacctactcattctgttaaatattcaatgacctatttccctccactgagctgtttaattagatcaacttctttttgaataaatttaatctgacgtttttgcaaaagaataatgcatgttccgtcgtcgatagcatcttgagaaaaagaaatatatagaagagagaaatacattttcttttataatatagaagagagaaatactgtcataggtgatacagtatactatctattggcatgagagaaattaaaatactattagagagaaatgagaggtgttaaaaccattggaatgcccatttatcattgttgtttgctaaacaacttcagtccagacataagattgatttttttttttttccaaattattttggaacgtaatactctcaaaagatgaatgaatcgagttatttttcaactcaccattctcaaaaaggagttgaacgaattttgatgaaaattaatctaattaatattttgccattcctgaaaaggatttctttcacacactgctaaggatgattgtgacagattgtgtgtttctcaaagataatacaataatgtacaagaaaattaattaagaatgatacatattaagattaaaaagaaaacaattaattagttgagctataagacgtaaatgtacatggagaatattcttggtgtagttgtagaaaaggggtgtcaattaagattataagagctggaagctgatgtgcaggatacaagagtaaaaaggggggaaaagccatttggtacataatatccaaagcttggtctttcaagtgaatgaatgttatttttttgtgtgtgaaggaatgtgtatgcggaactaccttgtattcaatgtattgtattaacttaataaaaaaatgtattgtatcataaagtggctttgcaaatatatatatatatatatatatatatatatatatatatatatatatgtgtgtgtgtgtgtgtttgtgtgttttgaacttgaaatggtgttttttcacgacctttgcgaacatagcacacagctaattaggatgggtgcagatcctcatgctcatgcataagctattgtgattagatgctttttcggtgattaaatgacttagtcaaatgtgttgggtaacacggatcctcaaatcaaatgcggaagccgaatgaaaaggaagaaaacaagagagaacacaatcaatctatttaacgtgagaaaacctttctcaatgtgagaaaagaaaaactcacgggaccttgtccagaatcaaaattcactataacaataatcggttacaatgaatcaaaacacaccaaggtggtggtacactcaacctctccaacaatggtgatcactcaaacgctcacagtgtttcactctaagctctcaaatatgcaggtacggaggcttactcaaatgtgctctcaagaatgtcacttgagggcttgaggctctcaaatattctctgacggaggcttagtcaaatgtgctctcaagaatgtcacttgagggcttaaggctctcaagaatgtcacttgagggcttgaggctctcaaatattctctgacggccgtctacgtctgagtctacctttcttcacccttaattaatgtatttaaagggtgaattaggtttaggatttttgaacatttaatgggcctaggtcaacattgaaggagtaaaggcccaatccaacaattctccccctacaactattagtgattttattaaaatgatggggtgtatctatccaccctggattgcatatagatccgcgtgcaggcttgctggaagtgagttcaacgtaccaatgaacctgccaaagatgcctatccacgtaccccatgaggccatgatgctgaaaggattaatctcttcaaagaaaaataacggttgaaaaaaggcaagtctcctcacatgcatggaacgttggcatcgaattagtaaagagaaatacaatatttttgtattattttctttatgtataaccaatagaaataggaagaggagaaaaggatgtgataaaataaaatgatatgatcgaaacatataaagatttttttttaaaaatgttgtaaaatgtcatgtacatatataaatactaggcaaatggttgatatatatacccaatttttaggacgttggaggtggacaaattaaagatacggaataaaataaataaaagagaaggaaaagacttattgaataaatatctagtttggtttttgaaaatgtagggttggtagtgccaagtgtgtctgaatgttgctatattctaaaatactctctcaaagtttagaacgctaatccatttagtctctccatcacccattaacactcatgtaagcattcatgtaactaattacctttattaattaagggcgataattcaatccatttatctatcattcatccacaagttaatccactcaatccatctattacaaacaaacaaagttaaatgaattgggattaatcaaagcttccgatgagaatatttgatatcaatatcatagttaaaaaaaattaaatgaattggatataatccatcaatttattttatgaatgattaataatacatccattattttttaaaatccaacgaattctccaaaataaatacttaattccctccatttttctgattagaaatccacattgaactatatatcatatcttgatccagccgatttgaagactaacttgaaggttcgtgagaagcctgtgaagactccaaatattattcttataattgatagctttttgcgaaaataatttactctgacaaaaatttgggagactatacttgtcaactttttggtagcacatgttgtacgaagaataagaatatgaaaatggtatgaaaggaacttggacccaatgaaatgaacacaaacattgaggctccatgagcgtgagattctcgaaacagtaaccgaagtcctaaaatcactgttacctacaaggatacgttatcttcggaggaaaaaaaacaatgcatgtgagtctcttctcattgaattaagtcaaagtatacggcgttttataccatatataactgcgtccattttttattttatcatattgaaaaagataatgttaagaaatttataataattgcgtccatttctctttaaaaaaaataataaatacgttcatttgttcttacctactaagtaaaagcttataagaatagtgaagctgtgatgaaggcacccgttttcaggtttctcatttattgagacgtttggataagctaactaggcaatgcaaaatgcttcttcatagtattaattattcttgttattattattattattcctttgtgtgcattttacgtggtcaaattcatcgttgcatttttacacgcaaactaacccttggttccgtaattgatgcagctcataacatcaactgagaatctttttattttttaaactggtcgttagcaaaatgataaaccttttcatgcataaataatcaatatactttgattagcttcgaattaattaattttctcttcaactaatcctttattttagtatattgtttggcattaaacataaaaaaaaagtatattgtttgacatagtttagtacggatgtgcaagcttgggatgaggggaaacgtaaacaaaacaaacgtacatgaacattaatctttgctatctttagtgagcatccacaagtttttttaaacatttttattttaaaaaatataatttaaattaaaatatatttaaaatgaagtaatttatatttagacgcttttatataaaaaaaacgttactattataataataataataataagacactagcagtataaaagtgtttgttattgttattcaattataaattattatatataataaaattattaatttttataataattattttaatatcatttttaagataggtcattgtatttgtttaattagcaacgtaaaaattcacactaacaaagaaaattaaattctaataaaaaacactaaagtgaatttggatggtccttgacatgttatagcttataagtcgtctaccatgtatgggccttgcccatgcacatcttgtatgggccggcagccaaactaatattttaaaacctgtccacttaatttaccttttttttgataacaaagtttgttaaaactaataacaatttatttattttttagaagaaagactatacactgattgtgttaaataattttatactattattcaatcacaaattaaaatatatgataaatttttttaacttttatgataatcattttaaaagtcatattaacaataatttatgattatatgataatgtaaaattattttacattataatgcataatcattaaactttttatttattcataaatatttttggaaacttaaaacattagtaacaaaatattatgtcatcgaaaaaataataaatttcaactattaagaatagttaagaaaagttacgtcaactaaaatttgtaagaacaaacttcagtgtaatttaatattgaaaaatgagtcccgtgaaaaaatttaatagtactcgtgcagtttcaattttaaatatatatatatatatataatatatatatatatatagcaattaaaagtgatgtatcttaattaataaatattgttttccaacttcctccaccgagaccaagagctataaaattggtgaaagatttttctttaaaacatttatttcaacttgatatttttcacttctaataccaaacaggcacgacttttgcctgggatggggggatggaacgtgcagtgttgaatgacttaacaactctacgttattgtaagtcgtaaacccttaaaaatttaattaaccactgtatttgtgacttggggctttgacatggaagacattccaacccataaaagagcatatattattcaagaaaacctatgtaatatctcaaaacacaaataattttcgatgccttgggtgatacgttaaatgtcgaagaaatcaaaggcatactcttctgtattgacgtcaaactagctggcctgcctctgataattttgcaaagcattactcacattaatttgagagaattaagaaaaaaaaagtttgcatctctcgttctgaatttctcataacatgcagcacacgtaacaataattgaatagtgcaacctttttctctattattgagccatttggataaggagaagcacttttgcgctttactcggcccatcgacaatttctagcatgtacacacttcatagtacccttggtttccacacatgatgcaactcataatttctacaaaaatttgcttcattcactttgtactctatgatttaatattggaaagcactataaagaaatcaataatgcgacatttaataattaagcatacgtttttatcatgatttatcaaaaagaaaaaaaaattatatgtattaattccatgtctataattgttacacatatatttcctcccatctcaaatatattaaaaaatcttttttgtgtgtgtcaagtataaataaatcttaattattaatgtttatttaatgagactatttctaaagcatcgttcatttaataagatcaaagattttttttcttatttgatatcaagtttcaatgaataatagtttagaatagttaaaaataattatttaataaaactaattaattttcttgaaatattagtttttcttcttcttataatcaagataagagagagtatatatattaagaaatatattttttcttcttttaattgagtcaaagaaagtggtgaatattgatggtgactctattttcaaaaatattttaaaaactctgttgatcatgccactgtaatatcggataatgtcatggttaagcatgcttgagattaattaatgtgatttaaaattttaaaaaggcagacattttttttttgtgtcacttccttttctcctctttgaagaactcaaacaaatattaatttgttgggccaatcttctgtagtacgcgtagtctacttttaacaagatagcgactgatcaatttaagaaaatagtatagttgcctcatgttttgaagcaaaatattatccacaaaacactagctagataatttcattgtttggtagcaaatgtcatggtttttgagtgttaggtctgctagcttgtatttgcaatgaacattgctgtctagcgtttaccacgtgtacaagtgattaattatacaagttttacactactaataatgtatgacacgattagttaatagtattgtagtttgttctcttgggatactgacaagagatttatttcctagctgctttatgtatggaaaaatttgttggaagaaataatattcatttcatgattttacgtccgcaagaaattgatcttcgactgtggttatgcaatttctttagtgaaaaaaaatacagaacttttacagttgaattcaaatcgcaaaagtattattagactattaacactaatttttcctctgtagtttgtttacatatacaggtgcacaaatgagagtatagcaattggatgcaacaagtatcataaattgctaaaaatgcttttaaagtcaaaatcattttgttaaaaaaaaaatacataacctacttcaaataattgttaatttttttttatataattgtccattttaagaagaataaaaaaaaagtgttaaaataaaatattatcaaaggcccctgaattcactgattatcaaatgggaagtatggaaccttatcctttttgttaccctagtcgttctgacatcaacaatgcctattatagagggtgttagtataatttgagccaaataacagcagcttactttgaatgtgcatattattaatttatttggataatacttgaaaatagccatcaagagtttaaagtaatgtcctcctaattaataagcaatgattatgactttcacgttgacataagccgttggaggggaccatattatatctacaagtcatattccataaagttcattctaaaccgttgcttgagttaattggtttatagcttgataataatatatatgcaataggattccctacaaaatttaatttattgtataatagctccagatactgaatgagatggaaaccgtccttcgtttatgagccaggcattttgcgcaccataataggtgggaccaacataacccaacaattcaaatcatattaaaccaaaagaaaataacttatcaaacatgaaaaacaaaaccatacagatcttacaacccgtaggaacaaaggcataaacttagaccagttaattttattttgttggcaacaaattattttttttctttccttctcctactttcccagacaagagatacaaaaaaaaggttgaaactcagtcgcaaatattattctttcatggtcatcgaaaagttagacctgattatatatattactatatacgtaatcctgtactctacctctcctcaatttattattaccttaactaggctaacgtgtgtggtgaaaaaaataataataaggcaacattagtctaacgtttgaaatttatttaaaagtatattggtacgtaaaagtcatgtgttaaattatgactaactaaattcattaaatactctcctagtattctttttatcatttattataaaattcgaaaacaacatcttactttgaaaaaacaaaactgcgcttgataaacaattggttgaatttacacttttaagattttatagacaagcatgaatacttgtataattttacggaaattgacccatcatcgatttgatcaaaacagtaaattaatagttaaatcggtgtgtcactaattagtctaatttaattttatatatattaaaaaattatatatatacagttatagttaatataatttgaatgaaaattttatactccaaatttaaaacattagaaaataacagttgaatcatccaaaaataacattatactataaaattatttttctcttttatatgttgactatccaaaataataatatactataaaaaaaattctttgtgttgtatcattgtttgctagtcttaagaaaaaaaaaatcccggatgtattaaacttgttagtaattatgagcagagcagatggatgagcttgacttagtggtaacactagcttggttttatgtgtgggaagtgtgtttgaatctgttgataacattttataattttataagatttgcttctagatgttgtttgcacgcatagaaaatcattctcaagattcaatatctgcatataatatttggacacgtcaaaacaatctttatccctttgtttgtaaatactgactgtacgtaggtggagtagtggtacggggttgaaaattgtcacacgggttcttttcacttaacttccaaataggttaaggtgctgccattggaagacttactatccatcaatttaatgttcaatgttgcacgattgaccaaattcaaaatacttcattttcacctttaagtatatgcttttctaataaaatcttgagtcattttaccaatcaatttacaatttttttttctctggagttacaattatgttatatagagtaggaccactgtaataacactattttaagtgagaatataagaaaaattaataataataattatatcaaaattaaattttaaatgattaataaaataaaataaaatctttaaacacaatgacgatggttataacgacgatcatgatgatggttgcaatgatgatagtagttacggtgacaatcttgatataaattaaatctttaacatatttgataattttatttgataaatcttatagaaactttgtggttaaatgaatttttaaattgaatttaaaatattttaattttaactttttattttaatctaatggttgagataaatcatttatattctcacataagattattattctcatatgatacattatctatatatattataaatttaaaaagtaaataaatcaaatagaagtattagtaacaattaataataataataaataaataaatatgttcatgtaactagatcgtaactagagtttaacatacctaaccagaagcatttaagtgagacaaatgtaatcatcctctcaggtctgtcactgggattcttattcacgttgcccccatccttgagtagtaatggtaaatcacgctttagttctcccttaattgctatgattggcatatgtaactttcgggcgactcagggtcatgtttgctgtaaggcaatttaggcaagtacattagactcccgtagaaattaaatgcttattacttaatcacaaggtcccttttttttaagtaccttaggtccatcaatatgtcattggcttaactttttaagtgactagtataataccattttaaaatatcaatgatacatatatacgttaggcgtttaagagattataaaaatgtgtagctgcaactaataagtaaaatgtgcaattaagaaaagaagatgaataatcaaattctgtctgattttgaagatatcaatttgtttaaattttatctgagataaacaatattataatatagattaaatggactaatcatcgtgtttattaagaatgaaatattagaattataattaattatataaaatattaataaatgattttgtaatcgaaaatattagatgacgtatctataaaagttttgcccaaggccctaaaatttctaaacacggccttggggtgactgttagggttcttgagattgcagctagaagccaatatttggggactgagtcggtcaacatacgaccggagatatacaaaatcttagaactattaaattacaaaaaatgatgtaacttgatccctctttgctctctctctctctctctcacaaacattttttatttgagtaaaaagaaattcacaattggtaattgactagaagtcttaaaatgaaaaaaattatttattagagtcatcataaaagaatcatctcttcaaaaataaacttttcaattcttgaagtgaatttccaccattaacattaccttgttattctgaagaagaaaaaagaagtaaaggcaattaacagtcaaaatacttttacatgtgattatcaggtagaaaatgacttttgagataaaagtacatcagtaaaaagatcagaaatttcactttttattcgtctgcaatggaaaatgtatcacaataatttttattgcaaacaaaacatgtacgtaagtatcacaccactgcatcctcccactaaaacgatttccacactcaccagccgagggtcaatactcaatcggcttcgtacgcaagggcatctccatctcactccattaaactgaacaagaaataaataaagtttgtaaaactaagcacaattaattaaaaattgaaaagacccgacttgttaaagccaaattaatattcttcaattaatgggttccttttcctctatgtttgttggtgacttattcattcttcccgtgtggttcttactgtgtaaatcgaatcaacatagccgaaatgtgacaaaagatatcaaggacaaaagaatatgactagttactgtgtcagctggatgaaaaaaaaaaaaaaacaagatagaaactttatactacttttcttcttttttaagcaattttggaaaagacaaaaggaaaagaaaacaataattattcgtgaaacactcaaacctgcaattctttcttattattttaaggggagaaactttatttatcgtttttgtgaacattccatgtgtttaaagagccggtaagcagtgatgcaccatgttagtgatattggacttaacaaaaggcctaaagaaaacaaataaagcctatcatgtatgtactaatagaatgatttcttttaaataaaaaaattaaaaaagggaccgataatagattgatttgatatattctatttagagcattgctaatagtgccgtctttctataggttttaacttttttttaggttatattatgttacattaaatttaagaattttaccaatatttttcctctaataataaaattatttaagaaattaaaattagtttcacatcaataagagaacatgtgtgaaaagaatgtgttataatgtgttcttagcatttctttattaccccacatccatatactttgtatattttttttataaaaaaagttaatattaagaataagttcttacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgatgattttgaattatcttttaaaaaatgtaacttttaaaacgacttttactacaaaattgatgttatttaatatttattttgttttatagttaaaattttcacatttttttttctttctagtgcacattggactttaatactgaccctcctatcttaattaacattttttcctatctaccatttaatgaaaacaatttcaacgatacatattattgttcttaaaacaatttctagttaaaattacaaggtaagtgttgtaaaatataatttaggtaaatgaaaacaataaatattattgttcttaaaatataaattatatgtagagggaaagtaatttatgatattgaactcaagtggtgtaagtatagaagatcatttataaaagtaatttatgatatattcataaattattttcaacttattttaataaaattttaattaagttatttacccatacaaatccttaattaattagttaattactctacatataatttatatgtaagaacaataatatttattattttcatttgtctaaattatattttacaacacttaccttgtaattttgacttgaatcaagttaataagtgaatttgagttgaaatgagttcaagttgaaaataatgtaaatctttttacaaacttacataagttatttaaagttttaaacaataaattgaatttttatatgattgattgttagaagaagaagaaaaacgcaaaattcgagtctaggctaaggaaagaagagaatatttttggtacactttttgttgcactttctggcgtgagatgggaaaatcagaaagaaaacaaataaaatataaaacaaaacaaataaagtaaaactagcaaagcaggttggtatgtggcgcagagccctcgctcgtactactgagtactgaccatcattattattattgttattcaatttatttatttccttttccaatggccaaagtacaaaagggattctcagtaccagcatattccttcgaatgttctattttcctctttaatctttccagaacaatagaacattaatcattaacctttttttaaacacattaatcattaacctattcaaaagtattaaaaaatggtatatctatagtattttagtattgttaaaaacaatatttttatcaataaattattagtctaaataatattaaactctattttcttaaaatttcaaatacgagttttataataaaaaatacaattgaaaaaaatatacactatcacaaagagtcaaatagagtaatgtaatatttttcattattctttttctgatgcaatatttttcattagttttaaaaaaattaaatgtttagtatttaaaaaatataaatgtatttaatatttaaaaaagaattcgaaaaagatttagaattatttaaagtcaaagtgtagtttagatctcaactgttttaatttattaacattaatatgacagctaaaattatcgctggctgtagctagctactttgtatttatcattgatcataatcataattatatatttttttcttttatgagtagttatgatattaatataaaatatttaataaatttattaatgactaatctctttccaaaaactcttctgattatctttagtaaattttatcctcttagtcatgtttttttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagttaagagagaatgaaagaaagaaaatgttgcttatttgatttttcatgctaacaaaatttgcattttaataattaatatttgttgataaaaaaataaaataaaaaatcactatttttaaatggaaacttcttcagcatcattttgtacactttttatgtattgaataataaaactttatttagtgagtatttgtgatactattcttcaatcaaatgtgtcatgaataacacttcaattatgtgattaaaaaccatgttcaagaatctctacggggagtttgatagttttttttttttttttaaagtttcccagttattttaagttgggattttaaatttctacacttgatatgcaaattttaaaaatcattttcagaattttaacattttcaagaattgagttccccacaaaatattaacatgaaagatggtaaaaatataaattttctttgttaaaaaaagagttttattgtgataaatataattaaaaatttctatattgcttttattagaccatttaatttaataacatttaaaattttgattcccaaaaatcttatatagatatttccaacaacatatatgaaaaatcaaacaaattttaatcatttataggaatcataattcttaggctgaataaaaaaaaaaaaaatccttgtaccaaacgtcttattcatagagtattcccaaccatgttgcttgctgtatgtcaaatccaatttctattccaatttatcaattgccatcataaatctgaggtcagttataaatgaccaatttatagaggcattaaatatagaggcaacaatctatttgaaagagatgaactagaattagatataatagtttagatcatatgaagttaggaatgggattcctgatccctatatacaaaaaattaggtatatgtaatgaaaaagggaaacatgagaaagagaagaatgtagcttagaaaacttactggaaaatgacgaactttgcactttaatgtctcaaatcaatggatacatcacttgatcaggtgcatcaccaaaagggtttgcaagagagacatcgttatgcttttctagtgttatgaccctgactgagtttggcattgataacataaaagaaagagtaaattatactcgtatctcatgtgttttgctcaaatttcacctattatttctctatttttacacattacttttacctccctctgttaatactgttaactaatgtcaattgaaatatgtgagcagataaaatagtctttacattttaatggtaaaactcaaattattctctcccaattaatttcagaatttaggattcacatttcatttctcttcaccatttactgttcgtctttctcttgttggcgagttctttttgagcgtctagggggtacgagtttctctttctctcacgacatcgttcaattcctattcaccgttcgcgatttattcactgttcctgttcaagttcacgaattcttcattgttcatcttctcgttcatgagttctccactgttccttttccagttctcgcgatgttcacgagcgcctccgtttgtcttcttcttcgacgttcacgagcgctctgtttctcttcttcctgttccacgatttctgttcatgataaggttatgattataagtgaccactggaccttgtatatagattactttttaagattatttatttaattttgatggttaattgttgtctatttctgaatgggatttcaatggagatcagtttgggaccacttatgatttttaaaatcatttgtttattattgttgattaaaatagtgttgatggttaggaccacataaaacacaatggatggactggaattcatttgtttattattgttgattaaaatagtgaacataatggatgaactggaatacatgaaatacatgactgtgtgaacaagccccttaagactgatcatgatgtgctgaaaatggggaagagtgttaacactatgtaccaaaaaagtgggttcacatctaacaaaaagttgggtttacgtccaattacagaaaaaacaaaaaaaaaacaaaagtcttaaaatattttcaggttgagaggaagaagatgagggtactttagatataaaatttcattaaaagtcatgtaaccagcatgtgcttaatttctgttaaattattaaacgatgttaggaaggaggggatctaagtgtaatatgaactaaacaattatgagattttttataagatgcaaaaaaggaaatgtatcggataaaatttgagtaaaacacataaaaatacgagtgtaatttactctaaaagaaattcttcttacaaaatttcactcataactttcatattttttttttatcaaccaaaggaaaactgaaaaggaaaattacaaaaacaaagaaatgaagaaaagagaaccaaggtaaaaaaactacttaggcaaatgaaaaataaattcttgacaacaactaattgaagagattgtgatttaacgttttgggggccgtaaacaattattgcattcttgacattgtcgtgtgacatactctattatgattagttgtacactagtacggatatattcgaatatgtaaaatgaaattatatacataaaaaataagtttttatcaatttatattttttttatgaataatttatcaaaaaccatattttaaaaataacattgtatcttttttttaaatatttataatattaattatttaccttttaatgacattataattgaaaaataaaaatttaccaaatattatatcttattgaagtattttatcaaacatttcaatataaattataattttaacgtaatttgcatattttttatttgtacaatagtaagtatatatcagcattttttgtgatgtaaacatagacaaaataatatataattaattgcacatgataaaatagaattaagaaagtgctaacaatacgttttaatatattaatattatctaagaagaatgttaaccacatagtttataacacaatccttctagtatattaaatactatgttttattgaaatttataaaatcttaagtcaaacttattaaatattgagtgagatgtagatataaaattgacttacaactcgaaatgaggtttaagggtgaagggataagggaggagggactgagtttgaatccctctcataaatattttaattaaaattaataaattaacatttatggataaaaaaaaaaaatgaaacctaaataattttatgatttatattaaattttagtaaatgcaaaaaaaaacatttttagaaaacttgctaaaaaatatatgttattaatatttctttaaagaaaatgttgtcaactgtttttacaaatcatcagttttacagctttacaggtaaagattttctgtctcaacaacctaaaataatactgaaattaatgatatgtttggtaggaaaaaaaagaaaaatacgaataatgatatatatatatatatatatatatatatatatatttgtttgaattaannnnnnnnnnnnnnnnnnnnnnnnngaaaaaaaagagaagttaatttataaaaataagaatatttttttctttcttatcacttttttttttctaatttaagcttcaaaatatttctttctttttttctcattccaaacatagggcaagactttagatcgatgaataatcaaagtataagtgaaggtaatataagctttgccagcatgggataactaaatataaataagttgccataaaaaaaagttaccaacgagaagcatcacactctaggacagggtgaaaaagttaatagataacatgtgattatattgttctcattcaccaattaaatatcgggaaattctatttccacgtattgtttgtctgacatcagtgacacggtccacaaaaatcaacctaaacattcaacaagatagactaaaaataggggagagaaataaaattaatagaagaaaaaagtgaatggtaatgcatcagacattgcgagatacttctagataactactattctcttaaatatttggtttaagtttttaaatgcataaagtctaaggtagtgttagattggtataaaagaaaattaatgaaagtacgagaaaagaatgaatgaaaaggaatgaaagagaggtgaaagaaaacgaaaagtatgtgtgatggttagagataaaatagaaatgaaaaaagagaaaaaatttaaataaaaatgatttgaaagataaaataagaagaaaaattattttaaatatatgacatcataattaattttatttctttgatttttctcaatataaaaaaaatattacatcgtgattctaactaatctcttcttcaacatacaattttcttaaaaaaatgtgttattttcactactttcatgtcattgtagagatgaaagtgtttttatgaatcacactacattttttaaaatttttcgtttttctttcaatacaaacaaacaacaatgatttttaactttccactattttcataccatttcagtttcattcctctctttttatgtagaaacgaacaaagtcttggcatgcatcgaaagaaggttgaagaaatagcgaggaaaattttacattattgtggatcccttgcaaaaatatttttccacttatatgcgaagatttgcgaagaaatgacctggttttgtgtgttggatctagttataacgttggctgcatacaaaatagaagagagaggagctcttgtttctcttgccaccacaaaagtgatcctaatttgcatgtttcgggcgggttagtagcacagtcccctgtgaagcactgcaaccgcgacagatctcgtcactgcatggtctcgcattcgccaccaccatgaacatcttgtctttatagatctgtgcctgtacaagtgagtttctcagaggaagaaatgcctcacataatcataaattattttattaataatatattttttaaaactatataataataatgtcaataataacattttttaaatatcaaacaattttaattcaagtatttcatctctatttccacttcatttatcttctaccaaacaacttatatttttctttatttttcacctatttctcttcttttaacctatctactttcctttcctctatttcttttcccctatcaaactcaaacttaaagagatataatgtttttttttttatcataaagaaatcaatggctgtttgagtatacaataataataaaaacaatgaaaaaaaagagataatttatatataataattttgttaactttattttaattaatgattaagggattatgatttttttatatcgatttggtttagtttatttgtagttttacttttatgcaacactttttatatctatgtatcgaaagtaattaagaacttgatatttaggatttaattattagttgtatgcatgaaaaataaaactatatatatatatattaaatatatcattattaggcaccaccaataataaaataacatgtcagtcaaaatcttaaacaaaaagaaaaaaatgactatttattcgatatgtgtattaatttaagtgggtatcaatacattaaaaaatatattttaaactcatgtataaataacattacttaattattaacttgaaaataccatttatggttagaccgtattttatttctaatttttgattgatcatttatcattaaaaaaaattacataattaacaactttatcgttatactcatcctcatcatttatcattactttcataaaatttaaagttttaaaaaaatcttaaaacaattttgttagtgcaaggacaacgaacttagagatctaacaaaaattcttcccccgattccttaataatcaacaaatttatagtacattatatttataaggcctcataatttatataatttatcctttttagaactatttttctcatgagacaattttatttaaaatacgatcaaatattaaaaatgaacacatctctcaacaaaaactttaatttactatattgtaatacttaaaaagttatttttttttcatcaatcaaaatccttatattacagttgtattaaatattcaaattgaatactttattatcctccatattattcttatccaaccaagtaagatatttttaaagaaatatctgtagtctatatagactctataatatatatatatatatatatatatatatatatatatatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgaatactttattatcctccatattattcttatccaaccaagtaagatatttttaaagaaaaatatctgtagtactctatatagactccatacaatatatatatatatatatatatatatatatatatatataaatgtttgttttaatttgtttgcagagaaaagaaaagaaacaaagagtggtgtcattgacattttggtgttgttgggcacctctgtgtctctctccgatgggtatatcagcttcttcccattcacttcatttcattcacccctttaactgtcatccattctttctctctcgaaaggacgcaccagtcaaaaaacaaaagccgttccagcttgaggggcaggggtaccaccaccaaaggccaaaataccaatcaaccatctcaacgaatatcctcttcgatccctttctctatttccttttctttattatataatcatctacaaactcacacacaccccctctaaatacttcctttacccccctctcaccttaaaacaaacaaatatactactaatagtactacttcaaactttgatatgcaagtggcggcagaactccaaagcacccatcaccaccaccaaaggcaaaggcaacaacaagacaccacccccatgtgccgccaaattcagctcactatctccgatcacaccgtcgccggagacgccggcgctgacgacagcgaggatctcttcattccgcccctcaacttcgccatggttgataatggcattttccgctccggcttccccgaacccgccaacttctccttcctccaaaccctgggcctccgttccatcatgtctgtccaatcatttcaatcaccctcttctaccttttttcttatgttgttgctgttgttaatggtgttcttgttaacattcgtgtttgtgtgtgcggttgtgtttgagtttgatgatgctttttgagtacccaattgatgaattgtgagtaaagtcttcatcttttccttgcacgctgttgctgattatttgattgagtgtttttttttttatagatatctgtgtcctgagccgtatccggaggccaacgtggagttcctcaagtcaaatgggatcaagctttttcagtttgggattgagggtcataaggtctatttctatctatctatctatgtcttcaaccttcttttttctggtcttgtgatttctcaccttccatttgggtctgattgttttatcttgaggtctatttgaataatcttgtctataataaaagaagatgataaagagataaaatgaattcagcttttcgtgcaagactaagttaaaatcagcttagacacttcagccttttcctgtaagtcaagtttttggagaagtttttaaacttttcttattttcttattgaatactaagtgactatacaagaaatttatctaaagtctgaatttgattgtggttgttctatgtcttggtaatttgcacaaagttcacaacaaaaagaaaaatgaatagctggcacagagatcaatggatatctaatccaattgacctgtctttctcattctcttctatattcttaatataacttctctctctttcaagagatggctgtggataattagggacctgatgaactgggaccattatatggatgctttggtttcaagtactgtttaatcaaatgggttgttatgagagggcttgggagataaaaaaaggggacgtaaagctggttgttgtcattattatttattcaacttgtttacttactattcttcttcttccttctccttctattcttgcttgattcttatggcgtaacttttttgaaatgtccctaactttataagacggagcacggattctagcgtacgaaagcaaaactacttcggcaacctgcgagagtcttaaaaaatgaataggaaaatgatatggtcagttagatatgaacattctacaattaatggccaaaataggtaaggatcaccatggaaatacaagcactggatttttttaataaaaaattctttgaagccccaacacaccgtccctttccttgccgaccgcttgacctttcctcaccatggacgaccacaacgccatcgcatatccggctgccgccatggacgaccccgacgtcgttgtgcaaccgagaatccacattagatcaaattaatttttttattttttctttccgtccatttagaccaccgtgggcattctccaacattctcccccgcatgatctgccacgctttgccgatattgaacaaacaagaaggttccattcattgttcgtatctttcaaaacaaaaatacaggataaataatacccattacagacgaatctgcaatgaccaaatgttttacggtgtgaaatttgaattctaaaaatttatccagatttacaaaattttgcaacagaagagttggagtttggttggaaggcaggtggaatgcgaggcagcgacagaggagcgcgtgagggaggagaaggtgaaaacaaggtcatagattccagatctgttgtttgagaggccatggatctgaggagcgagtccattttcagatctgaagcatgaagtgtgtttctagatttgacgcatgagtacgattgcagatccaacgcatagcgatgacggagagggaggtggaggtcttcgacacgccggtgccgccatgaggactgacgaggatcttgatgttgttctttttgttgttggagtgtgtgggtgttaagtcatttgtcgaaagggggaagattttccagtgaaaaatatcaagccgcaagggagacacggcgttgcagatgacaagtggtagagcagcaacgtttccttgaagaagatgaaggcctcacggtgtgaggctgaacttgaccatgaatggtgtctacgacgccggtgaaacaacggagannnnnnnnnnnnnnnnnnttttttttttttttttttttttttttttttttttttttttttcagtgtaagcatgtcctctgtaatgtcagcaacagttgattgcatttaatgcaccgtattaccccacggtgggaaaggagtttctccatagcatctccaatggatggtgggtttagaaaccgtttcttagaccaatggataatatgagagttcatttaaaaaaaattaaatttttaatgtaagaaattctttctagtttttacaatttcttattttttcgaatatcactaatcgtggagattttgtggagtttcttatattagaacaaaattttgtaagaatttttcatgaatgagataatatcacgtcagttttggtctcgttattgttccggattatacgttgttttatttcttgagcatatttctatgcgagagtcctcttcaatcctcactcgtatgtgcacagtgaaattatgtcataccaactttaggatatggaaatcagggttgatggaatccaggctggcatgccaagtctttttccttggttatccaaaatgatcacaatcatttgtttttcgggaataattaacagttgggagatcatatattatacgtgttgtctgtctaatgggaccattatggatatctcaaaaaccaattctgttcaagaagagcacagatttgctatttgattatagtgcaagtacaaaaagaagggggaagggaattaataattgttcagaagtagcaccaaagtcatgatcaccctaggaaagactaggtaatcaaggaagggcatagtaaagtatagagaacatttcattattacatttggagattgaatttatgttattggtggatttgggcatattgtatgttgaatttgaatgacttctctaaagtgatgttctctaaagaatagtgcactcacaacccttgattagaaaaatgaaagattgcgattataattaattttaagatttgttatatatgtatttgaatttatcaaaattctcaactgttgattagaaaatcaacagttgttggtgtgcgctttgttctctaaagtgtatatcccctcactttcactttagaaaaaccatagaaccgaattcattgaattaatatagagaatacttttcctttatattgttgaattcctgactctctattccatgaattttgtttgaatattaaattatggaccaatctatatgtgaagtaaaacaaggggaagcagtacttttattaaagccatccttgattatgatactaacttgtgtctctttccttaattttgaaattgttttcatgccttttttgcccatcttctaattttcatgtttattcacatctgactccatctgtggaaaggaagatggtcagatgaatgagaattgagtgatggtttatttctacatgcgtgtattgtgtaagatttaggtctgtataccagtaaaaaaaataaaaattgggatctgtatagatacattaataatctaataatagcttcttttggatcccataaatcgttcagtcaatcaatattagtagttgagaaatttgccaaacattatcctcaaattgtattagccacacggcccacaccctctcccctcttccttttttaccaacaagtttagttgacaaagggtgatgatggaacttgattttaattttatgttaagaaagcaagttttagataaccttgaaatcttctttaaccttgtgcatccaggagccttttgtgaacatcccagaggacacaatccgtgaagcactagaagttgttcttggtatgatgtagttctttacttttaatcccaactgcagtttcaacaactcatttaattttgctagcaataacttttggggatcaaataatgcagatgtcaggaaccacccagttataattcactgtaagcggggaaaggtgagattattgctgattttttttttttataaatatttttgtaataagtaatagtgtcactaacaatataaaacgtttttgtaatatctacccatgtgagatttcttgttaaaagtatgtaatttcttccttttttttctgcatgcagcaccgaacaggttgcttggtaggatgctatagaaaattgcaaaaatggtgcttgtcatccgtctttgatgaataccaacgctttgcagccgccaaagccagagtttcagatcagaggtttgtagagttgtttgatatttccagcctgaaacatttgcccatacccttttcatgtttgaagaggtaacataaccaagctatgctgagttgggtttactttctttagtttgtgaaagtgaagccaaggttcttccttgaataaataggaaaaggtgatgaactctttcaatgcattgcagcggcaaaggaataattcttctctcattttcaaaataagacaagaaaattctaggaataatagagcattacctgtatttgtatgtgttaaaattctgccctatatttcccttctctccctacaattggctcttagtgtaccccaccaccttttgttctattttctttctctttgtttttatgtttttcttggctgctccccattcatcaacaatgagtgtagatatatcttgattttttctcgaggctcagaaaaattcaagaaggctacaaaaatgccttgtttgtctacccaaaatcttggtgggtagtaaagcagaggaccttataaaatttcatttgctagattaatattgcttttcttattttatgttgacactagcccagttcagtgtgatggttattctcttacgctaattgcatgctggtggaaaacgtggcagtgttttgtagggacttacatatacttgcattttattataaaatataaatataagtggaaaatttatgcactttgttagcagaatttttttaattccttttataatatctttttactcatcttatttatttattttatgtttgtttttacaaagtatttggaggattaagtttaccaatacatttttggtaagannnnnnnnnnnnnnnnnnnnnnnttacaaatttttgattggatcttatttgtataatgtctgtgataatgacaggaagatacacatattttgcatgagaatattatgaaaaaaatttaaggtgagaaattttatcatgaacgtattaaaatggagtgtcaaaatagcaataattgaaagggactaaataaattccttaattttcttttataagttgaacattgtttcctttttaaatagaagtttaaaaaggaaacgacaaatattaatgtttgaagtgatattataaagtgtaatctggatcaactcaacatatattaaagttatactgccaagttttttttttttgacacattatactgctttgttttttaccattgttttcttccctttttcgttctaatgttctaatttctcagtagacatatatgtgtgcgttttattaacatcgcaaaagggtaagccttgagtttcttttactagttctgtgggatttttttatttttattaagcaaaataaattgggctagaacatatttcctaaaatttttatttagctagaaatagaaatgtaattgccaattttttttataaaagtaggaaagtgttttttatgacaaactaccataattgtttgtacgtacatgtatacagatttttatatttaattatatttttgtaaataaatatattctatatattatagagtttcaactaaatggattatgtaattgttaactaaacaatcttcatccttatattttagacttcaatcggttattaaaaacatagttgtgacaacatatataagcacattttggacttgggctcaagctagtgtcagtttttttctcattacgactaatttccaccagaaaatatttgaaatgcattttaacgactttatcatagttttaagtttctaattaataattataatcctttattttcgttttaagtttttttttaggaaaaaattcgtttcaagttaaacgtcccaatttaccaaattcataaataaactagaatgataggttggacatgttcatgctatagttaaaacaatgatttgttcttataattgaaattttaattattattcaatatttgattttttatattcttctgtccatattttttatggtaaaaatccttcggtccatctgcaataacagcaagaaatttctcggcattaaactgaatagaaaaagaaaataatttaattctaatgtaatttcagtattaataaatttacacctacatcatacgatatatcattatcattattacgaagttgacattattaaattattaacactatcaagttattaaatataatgtcaatatatatgtaagtcaaaatatatttttttacctcgacacttattaaaattaaactataaagagaaattcaaactttatttctcatctattttaactccttatgaatgaattctctctatttgtttcgtcttgtacaattagaagaacgatagagcaaaaattaaaactgctagattttgtaaaaaaaaaaaaaagcaaaaataacctaaaagaaaaatttagagtaacaataatgagtattacattaaagtatgtaataatctcaaatgatttcttctcgccgatctaatttcgcaggcgtaaactaccgtttttgctttgctgttttcttttcccttttctagatttctttatggccactggtctaactgaaaaatgaactgatttttcttttttgatatgtaatttctttataggttggactaaaactaaggaagggcaattgcgatggtgtgagctcatatttcacactcgagcaaagcatttgtgacatttatcggggaatgaagttacatgcactctgctgaaaatgtgaaggaaagttttgtgcggattgattgagcaagaccaactaccatctctttgcaggatcatgggttcaatgatgtctctctagcctacgttggagttgaatttttactcttcttgcttatgtagttgggttgggtgtcctagaagtttgcactgtgaatcattttgatttttagcatatagttgacatgtgtaatggaaatttagatatgtaggacataacttttatacacatcatattgagttgaatggtttaaaagaataaaatgttaatattttcatatttacattttatattagttttatgctcaccattttacgttaaaaagaaaaaagttttactatagaaaagtagttcaaaatgtatatatacaaaaaaagagaatgcaaaaatatatattttttaaaatatttaaatatgttttcatttcttcaaaagttgaattgttttctttttattccactaaatttaaagttatttttttagttcttgaaattcacaaaatactcttttagtcctactacataacacgagccaaacatgaaataagaatttcacaattttttaatagtcaaaatttgattttctattttacattttaaattacactcatggtgattaaaaattatcataatcaagttagtaaaaagttaaaaacctatcaaacactttaaaaattactttaatttttttattgacttaattttagtaatttcaaaccaccagaaaaattatactttaaatataaaatagaaaattaaattgtggtggtaaaatttataaaaaaaaattataaatttcttattttctatttgacttacattttataaaagaacaaaaaaatattttatgaattttaaaaatttaaaaagataatttcaaatttaaaaactaaaaaaaatacacacatttaaaagattaaaaacatatttaacctttttaaaataaacgtgataaggattctatatcttaatattggcgatggaaaagtatgaatatcaaggagtagcattgtttccattacacatcatttagctttgttgttatttatttcggttgttacaatcaatcatgccccaagcccaccatctccaacgtgcctcgagcaatcatcttcacattcacatatcttattattgttgtgaattttttgggttctatttgcattttgttggacatacattggactggacccgagactatgtttctgattgggatttaaatcatgcaccttccaaatttttaaaaatctcaaattaccctttttaaattatatcatttaggaataaacactttcaaaatgggtattttatttagtaaaaaatagatttgccttctagagtaggtgttctataacaataaaaaaataatttttggaataggtgttccataacaagaaaaaataatttctagaataggtgttctataatagtgaaaaatagctttgccttttaaaataggtgttccataatagtaaaaaatagctttaagaataaacgtttcataacaacaaacaataagaataaattccagagtaggtgtttcataatattaaaaaataactttcaaaatagacgttccataatagtaaaaaataaattctaaaatagacgttctataataaaaaaaataacttttaaaataggtgttccataataataataaaaggatagttaatattttcaaaacagaaagggatgcaagatacatatatgcaattgctggattcaaatccctttgtgtttttcctatttggactgcctcctagtcctttagattttggatgtttatatattgggtttggtttcattaccattgggctgcatacctacaatatagttattataattccttctctttatggtctctaacactatggttggcagggtacaatttgcaacttcctttctcttttcagacatcaggccattattgataatcaataaagactcattaaattaaactaattaaaaaaatttaaatataattttgatctatgaaaaataagatcattttgattttggtcctttaaacttttttctttcaattttaattcccgtaaaatttaatatttttgattttattttttattgtcaaataacaacgttaattattaatcataataataacatttacaattgagtgaattatcatgttgttaaagagtatcactaattcaaaacataatttactaaaaacatatctgacatattaattatgttttttttaatgataaactatgtttttaaagtcttatcctattagttaatattgtgataagtcactagactattaaagttcatattatatcatcaattaacattattaattgacagcatagattaaaacaaaaaaaatactaatttttatgggaactaaaatcaaaagattttttttaaaggaccaatttaagtctactgatactaatatttttaatttgaaggtgcttaaaagtgagttactcaattttttttttccaaacataagagtcagattcaaaatttggcgtctccttatcctaattcatctcaaagcactgaatttaaaggtgggatttgcatctaggaaagatagctgaagacttggaccattgattagtctcaattttcaactatttataggctcattttcttatatataaatcatcttgtgctggaatatttgagtagctatgcataggtgtcaagagctggttttcttatcgtttgggaagcatggccctttcaacatcttttcttgctgtagtcataactcctttgtaccaaaggaacacgggttgaagtatttcaaatcattgatgaatgaaaatactcatacggtagtggccatgcaatgtcagacttttaatattttagttgagtctatcagtagggagcactcatacggatcaaaattggtaaggtatatgagtatatatgatatctgatatatactattcattcccatattctcgcgtattagtatattacacataatatctgtatgttgtatgaatctatttgaatgggaaagacaacataatttagatatgtaagaataagtgaatatttatttttggctttaatactattttgcaaattttctagttatgccagtaattagttattattcatctaaaaaatagtcatttataaaggaatgatcaatactctttctctgtgatattttcgttttgcacataatgtttaaaaattgaatatgcactatgaataaaatactcattgacttaaataaatattaatttggtatttttgtttaacataaaacattttcttcttagaattttagtaatttttttatcattaaaaaatatgaaataaaaaattggggtcctgagtaataattggcatccctaattattataactggaccaagcagcaagtgattcatatatagtgactagaggaagtggtccaaatcgactcccaagatctaaggacacatgcacgaaaaaggagcagtggtggatctaacactctgtactctgtatttgagcaaatgcgaggtaggttacatggcccaaaaaagcacacataattgaaggtgggtccaatctcaagttctggagaggtcaatgtgttaagatttataattcatcagccttttagaaaagctgctttatgaattatgaataatgtttccgcaaccctaaagataaggaggagaacataataaattaagattgtgacttctcataattaacctatcgtacttttttatatatttggagaataattttttttttatcttttacaaataaatttatactgtctcatattttcaaggatcaaaatagattatccataaaagtttaacagttaagctttgtcaaagagataaataaatgttatattaatctatgtgctatattccaaaagaaaagttatgaacaaaaacttattttctcttttatcttttttcatagtattttttatttctttattttttcatcatatcacttattatatctataataaataatatgggcactgaacttaattatactcaatagtaattggttcatttttataaaaaattgtcttaaaatttatttgaaagataattttccattgatttgttgtattttcttttacaatgatagcatatacctgttaaactaaaaagaaaagataaactaatgaataatgcaatataaaattaagagagaatttagaaaaagaatgtaaaaagtataagaaaaaagtacgaaagtagcaacgtcaagaataaaaactaatttaatttttcaaaagtctatcattattttaatgagtaatttatttatggagaaattctatcaacttttaaaagaaataaatataaaatatgttaaaaatgatgttctaatcaacatcgttatcaacatttatatatttttgtctgcttctgtcatccgcacctctttttaaatgtcggaaaggttgctttcgcacttaattatatacttagcacaagaaatgaagcaaacctaaaaatcgtgagaatgcttcccttaatataggagtatatgcatgtgacgtgtttcaattcctttctatctgcctgttttggctgagacatgcatttccttgttaatgtatgattatatgcaaataacaagtttcaccatatcttcacattcttccacttaagtgctaccttttctactttaaaagtatgttataaaaagatgggttctccactttccccaagttgaatacttacgtggatgccaagattctgtcttataagagttaattttaatatatatattaaataatgtgatgtgatgttacgttgatgtgatgttgtgtcgaacgtgtatcgttcaatatgtccaatctttaatttctagacttatagtctcttctttaaatttattacatgttcaggattattatcttcttaaattttagttttattactttttataaattaaaaatctcaattacatgttagtgaatactgggatgtcgctttcaagcatgtatttaaggagtcattaccatatttcctttcttaacctcacaaaagtaatgaccggatttctggggtaattgttattcagttcgcttctttgtccacccgttgttaaaaatacaaaagttttaattagaagataacgtcacaaccacctatttttttactattcaaatttcatcctgactaaatatgcttccttggaattgaatatcttcatttcgttgcatccacatattcctttgtcctagtaagtgtgtttgatatgcatagtcttcccgaagcaccatcggggcattcacattctcatgtgttctacatcacttggacaccatcattggtggcccaaaacccaactagccaatttgaaactcatatgaagccaaaagcaagaaagaggaaaagaaaataatgcatatagagccaaaagacaattcatagcttttgctagttaaatagttatgtttttattatgaaatatgagattttgttgaccatttcgcacagtcataaatcacttcaactttgtgtgaacgttgggcaaaatttattttacaaagtttattttagttaaaattgattttaaatttaagtgagtgatgtttagatgcttttttattttaaagtaataaaattaatatgaacttttcaccaaagcaaaatgacttaaaactatttcaactcaaactatccattctaaattcaaaattaatttcttagtaggaccgatgtgaaatcaaatagacacataacaaatataataatagtagtaattttattatattcttttagtaaacacatgcatcaggtacttgttacactcctcccaaagcaaacatggtggtaaggctatagtaaaaatatttaaacagttgcaattggaccaaaatttgatgctttaaaggcttcaaatcttggctccttggcctggaacttcaacttagcatagagcttcatgtagtcttcaaacacaaatttagggtagagctggcttttctcctctgcctctttctccaacaattctggagcagggtagatgatagcatcactgccagggttatagaatgaggctatggacattctggtcccatcagtttgtgctatcacacggtgctccacactcttgtacttaccattggtgataacctgtttttccacccattagtgtttgatatgagtaattttgttgcatctaaattgtttgtagaaatgtctactaagcaatatatattaaaatcaaccaattaaaaataatcttatgtaccgttttttaaagtagttattacaatagttgataatttttaaatatataataatttatgattgaatgacagtataatttttttttgcattattggtgagtctaattaaattcatatattaaaagtaataggaaataaatttacctcaagctgatcaccaaggttaacgacaatggagtggcgcatagggggcacatcaacccactggccatctttgagaagctgtaggccactgaccttgtcatcctggaagagaagaataatcccaccggcatcggtgtggggacgaagaccctttaccaggtctgggttggggcatggagggtagttggcaaccttggtgccaaaagttggtcctcttgatccatggaaagccttcttgaggtaccctttctcaaggcccagattctcacacaacaagtccaacagctgctctgctagtttctctaacctcaaagcaaaatccttcatcaccttcctgcaccattacctcatgttagaatcttgtaaaagagataaacacagctgcagtttcaattctgaaatgcacagtcgtatcttgtattttatttttttggttttgaactcattatttggtgaagtacttgtagatactctaaaagaaattatgaaacagaagtaataatatatatatatatatatatatatatagcaatgttcaatcttaaggacttctgctcttatccattttgtcaagtcaaaatcaaggtgcaaattctgtgtcagttatttgggattttgtgctaacttgtatttgtaaaatactgcatgtcatccaaatcacatgcaatattgtgtaatgttataaatgttttgttttattgtaacctgtactcatccatgagatcagggatctctgagatgtttgattcagggaggtgacgcaattggaaggtgctctcccaatccatgtccttgatttcagtttggacagcatctagacctttgcttgccataaattccttgaacctctcttccatgcatttcctgtagtgctctttggtcaacctctccatagtgtccaataggtcatggggtatgccatgattcaccagctattagaattttgaaagcaatcaaacagtaagaagagacattattaagtaccaagaaaaatcacaaggacatttatttggtgggcaatgtagaaatgaatgaggtaagaaaaggttcttgagatacctcaaagaatccccagttttcacaagcatcctttattttctccatggtgtcgtttctctgctcaccattgagcttctccaagttgatcactgggaagttagtcatcttttgaactcaaaactcagctcttttttctatctgcctctttctctattgcagtattgctctgtgcagattagagtttgctagggtggtatttatagaccttgagaatataagaccaaccacaaaaaaagaaaataagaaaaatctcgcttactaataaaaagaatatgttgtaatttgctttctattcacccttgtttttaatctatgatttttatcctatagaacaaccttttctttatggttccgtggttgaattgtcttgccactgtggtatgtaggttggacccacttggtggctgatttgacctcttgacaatttgaccaggactatacaaactgccaccacctcctatcaattctcaaatattttacttcgacctttatttttgggtcatatgaacgtgatttctaggaaggagcttagccaaaggagttccaagattatggtatccacgttttagaataagcttggaagatgaatttgtattcctctccacgtgattaattacttgcatatttttcctaattaggagttgcttgagccccaaaaattggtcagatatggaatagttactaagggtgttgtgtatgcaaatattcggttaatatttcatctagattagaaatttctaaattaaaggaggctcacgaaatataaaatgttttggcgtccattttactcaatcaagcaaattcattcttcatggtgcatatgtaacaaaaagaaaaagaaaaaaaagaaacacaaaagttgtggtccttcaattcttaagagcttccgtgtcattcctatccatgatttagtcatttgtcaaacatcttttttcattttatgttggaatcttaaggtaactttatttatttcctcctacggtttcatgagaagtaaaaatggatgaggagataaaacagtatataagtagcattttagtttggtcacttagagtaatagatgaggataatcttttaaatgtgaatcttgttgaattattaaaatctgtaaatctgtaatgcgtgcagaaattgttgcttaagagcttgagtcctgaatcacttactgctttcgttgagcaattaaatatcaagaaagttgaaataatatgaataactaattggaactgttaatgattctgaatcagagcactttcttgacgtaaatctccgtgggcattaggaacctagtattgtgaggatggtgagcacggacattgaacaaattatctttgagggtttataagtatcaattatttttatatgcatgaaatcctttttctttactattcaattacacttttaattcctttaatttgcattgcgtgtgttttatatttagtctttcaagttttttgtgcgtgctcactaaattattcaaattttaaaattaaataaaattggtaatgttatttatttttggctaaaatacatttttagttttttgtattttttttattacattcagtttgacccacttatatttaaaaaaaataataatttaatcttttaataacttaataacagaagtaagactattttcacttaaagaatagagctaagaaagtatttgttaactgattttaacatcgagaagtgatcaaatagaatatatattatacgtttaagttaaagagggtgatgcttggtaaagtctaacctccggcaagatcattatcattttaaaaactcttgtttataactttgttttaactacaaaatcacaaaaagagtattttaactaacatcaccttcacattgtttggttgcatttatattatttggttcacctgccaaagagaggtaacagagactaaatataattaattttaaaagtagaaggactttaataactcaatattttttttttgaagaaacaaaatcacagctttacatatataattaagacagtgttgaaaatagtctaggaacaattttttcgtccaaattgagagtattattgtaaataatttaggaattaatttttcacatttttttcttcatttaatcataataataagtttttacttttaccaaagcctatgtataattgaagatcctccaaatggaaggttcatcctattcaaaacatgtcacatggtattaaatcaaatagtagtattaaattaaaatgtttgtctgtctaaagaattaaatatatgacgaatttaactatattaggtgttaaaatagttttcaatgcaagtatgtcttttggggatctcaccctaatgtgtgtgtctttattttgcaaaaaatggcgggaaagttactgatggctgttggtaatgttcaattgacgctgcatgcaaaagaacaacgcttatttacagttggtcatgcattggccttgtgatcaaccctaaaaattcttatagctaaaaatacttatcaaacatactctttatgacaaagcctcctatacattttcatttgcaaaaattcagaaggcccttggaactagggagagtttatcccagtgggttggatgtccagctaggtgccataagtaacgcgccaacaattaattttgatagatacacaatacttttgttttatataaagaatttgatacatacacaataaggtatcctctgcgttcaactatattattaattgtctattgttgacaacccaaaatcagtgtgaatttgatatatacacaataaggtatcctttgcgttcaactatattattaattgtctatcgttgacaacccaaaatcagtgtggactaaaaatatttgagtagaacgatgactcgttgtgtctattgattgcttctatatcaattatgtcatttgaaaaaattaacttcaacatagctttctctttagatggatgacaagatgctatcagcgatttaacatgaacgatatcgtttagccatgcgttcaggaaaaaagaaagcagtttttgtctctcttttaaacgtttgcgctaatttcattccattctttaatttagtaatgattgtttttcgctgttttgattacaatgatttaagaatgattcgctatcaattaaacaaataattgaattatctaagttttttaaatgaaccctaaaggtcagatagaaaactattcaaatctttaattaatgtaaactagccgccattaaagcctttctccttttgacgtggctgctcttagtgttagatttagaacaatgctacatccgaaagttgcttgtgatggtttgctgtttgcatgcaatttgtgcttttttctttatatatcgacattaataagagcgtttgaacgaaaatcgactttctagcttccttgattaaattgttttactccgttttatgcttctacgttaattaagttggaaacgtgcacatctttgttactagctagcttgttcattctgcgtccttataaatttgctcaataaatttttatctaacgtttcatgatggaaaataaaataattttgttttgatgacttgtagaagagtggttgatttattccctaccttgatgttggaaccggacgatgaaccaaaattttaatatcaaaaaaatatagtcatacctaatatttattttttaaagaaaatattgtaaaaatccttcaacactagattttatatttgaaagtcgattatatgtaggaattatattaacacttataatgtccgtcataaagagggaacaaaactaagataaatttaaaagcatatttatttttaaaaaaatagaaaagaataatattcatttagaatgaaaaataaatgatggaatttaatgtttctaaaatgggtttggaccggttggtctgacactgaatcaacctaatctatcataactcagattataccatattgattaaaataactgacttaaaaatataaaagaaaatacaacttcattttaatagtttaacgtttaaatgagtttgacctgttacgtcatgtttagtgtgcgatataatttttctaaaataagaatcgtccttctttgggaataaataagaaaaaaccttttacaaatatagtatatatagtaccctcacctctctaatgaaaatgttaatcactaatgaaaattaaaaaaaaaaaaaaacttttttaactgatttctgatttatttgtagcaaattagtccttattgtgtaaatcaattgtcgacatataaggtgttaattggccttattcaacagcgtgacactcgttgcctttgacgattcattaattaactagaatatattttgaaagtttttgtgtccatcaatatcaatggaaaccaaattaatgcctaatcaaactggttagtatatttcggttgtgaaacacatgaatcaaataatatactcacacgaataatttctgcttttgtttttttccgttaagaagagaggcagctgcatgaatggctactatttttccccccttatcttgatcataaaatattaaaatgtatgcgttttgcctatgtctcgtgttaaatttacgtatggctgacattttttgcttccgaaagatggataagtatttctacgtacatagtatatattagaaaagccaaacatttggttggtgaaaatgttgataattagggtctattagttctcatcagttttttttttaattactaatgaaaatttaaaaataaattttaattacttttttcccattaaattattttttaagatacttttgatcctattattatttaaatctttaattatatcccgagtttttttaagagaaaaatattccgtgtttttaaaaaatagttcagttgaattctttacttttaaaaggttcaatttaagtattttattatttaaaatagactcaattgatctcattttataaaacaataaaagacctaattgaacatttttaaaattacagtatctaatttaaatttaattaataagaaaaacaaattgaacctaaaaataaattatacaatgacaaaagtaattatgacaaaagtaattaaacaaaaaaagtatatcaacgattgctatttacaaattattgttatttttatataattataagttttaacctaatacctcaactaaactcttcacaactagatcgaccttaatcattttttatgtaaatcataattgacaaatgtgacttgataataataaaaaattaaaaagtaaaagtcatgtatatcaaatatgaattttatttttcaatataaattaggtcatatttaatatacacaatatatataacaacgagcggggattggaggacgcagaaacatgcatgtgtctggctagtggctccaccatcacagtcgcagagaaccattgctgcagtgtgcactcgcaggttaaccctacatgcatgtccaacgtgcttctcagtctttcccaccatgactatgtttcaggtttgcaaagaaaatgcacatctcactttctatgtacccgtttttcctttctaaggtaaattgcgctgtgatatctccaaacacaattctgaaaaagattttataatttatcttatgttagccgtattaaatttatcatacattttgaataattaatttggtgatagttatatatatagtctataaatatctaactacaaaaagctcttcatagaaatgttttatttttatttaaatttaaattcagaatttaacattttgatagatgatctaaaacaaaatataaaaaaagtacattcatatttttgaattttttgttgacccgaatacacatagaaaaagacaagtataataatagaaaaaaaattaaagcttgtaaaataaaataaaaaatgcaattaactcttcacattatatatttatttaattattatacttatgacaaattaaaatggttaatagatcagtgaagtgtaaggactcatgtactagttaacaatatttcatgttacttttagatcaatttatacagaaacagtttgtccatatgaactaaatagatataccaattgtttccttcttttgatttcttcaactacaatgctacaaaaaggagacaaaaagaagaaagattatagctttaataagcgtgccttttaagaaagcacttagataaatggacatataccacttgaaacacgacgatatgtaaaggcttcgacagtgaattaagcataattaaaacgctataaaaaaaaatcttggactataacaattaaaactgtacatacaaaatttctgatatgtaaattgtaatacactctttatggaggacatttctagtgagagagggtattttattgataaattacattaattatccctgaaatttcatgtaattatacaagcattcatgttttttttaatcataacagttacctctatatactatcccaattatgtaactacccttgtagatatagttgtgtgcttttcacaagtagttggatggtatcatgagcctatttagttacatatatatatatatatatatatatatatgtatgtatgtatatattatgtaatattattaacttttacttacaagtggttaaaagtaaataagtatacttatcaacggaagtgatcaaattatattgtataattttgacaattattatataatttttataatttgatataaaatgtgatttttattgatcaaaccgttggattatatctacatattatcaagatagtttgtgttaaattttgtcaaaattgaataataacaagaaggtaattaaataatttatattttaaaatattttaaaatatttatattacgtcaattttaatctatatgaataagataacaaatgattttagattaatatgaaattttgtatatgtaacttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgtaaaatgaacttttaacccaaaaaatgagtttttaaaaaatattattcaattgaaaattataaaatattgtaaaaaatttatagaatattataaaaattgtcaaagtttaagcaattgaatacctacaagtcttggaccataagagtttttttgttttagaattattatttattaaaatgtaagtacacaataactaataagaaattgaacagctagaaaacaaattgaatagcaattgaatacctacttatttgtttacccttcacatatcataatagttaaaacaattcatgcaatttttggataaaacacacataactaagtgaattatttatcattggtccaatttgtgacatatttcttgtgaactagacactaaagtcatatgacattactttataaaatctatattttatgtagacttattacttaaaaacttattatggtgttgcttaatacaagaacttattaggttatattttttatatataaaaatactatttcatgtaatatttaagtttaacatttttaacttattttattttcatttttatctttagtatatatctttttaaaatcctttaaaagtttctaaaaaccttaaagtcgagacactcaatttctttttctaannnnnnnnnnnnnnnnnnnnnnnnnnnnnnnnnnnnnnnnnnnnnnnnnnnnnnnnnnnnnnnnnnnnnnnatatatatatatatatatatatatatatatatatatatatatatataaattaaaacacatacaagtaacgaatacaatctcatgatacaactatacatgatgacgattgaatatacaaattaatttttgtatttgaccctctcaaagaaaatactctatttttggtttatagctattatagcgtccaacatcgttttagattaaaacttctaaacttctacatggttgttaaacgttagtatcaagcaagaggaacatgtacacattagtgtccaaagaacaaaaagaaagatgactacaaagaagctacaacaacaacaatgctaaagggaccagaggaccctatgtgtgacattgaatacgaggaaaagactcaaagacaaaaaagcaatgacacaaggggatacatgaagccagtcaaaccattgacggtgttcatttaagtgtaaagagtctcgagggagtattgaattttgtgaaaaaattatagaataattgcacatagattcaaattattacatgtgagtataacaataaaacttaactagaaggttatctaagacaaaaactaattttgattaatttccatgagttatttcagacggacatatactatatagaaattattttgatagtgagattgttgtggggttaatagagtggagtcatattgtaattctagtttctttggttggtgataatggtggttgattgtcatgattaatcaccaccatcaatgacttctatgatcttattcttcaatcctaaatttcttcatcatagtatcttcaaattgatataattcagaagatcatagtaaaaaaaaaaaaaaacattaaaatatcattttccagcaattaatcattttttttttattttaagaccatttttggactcaatctaaaagtggtggcattaacaccaattttgttcagtcacattgaaaagtgaaaaaaataaaaataaatgctatggacagcaaggaatcaatagatggaaaaaaggaagaagataatggaaattgtacttttggccgacatgatagctagagaatcgaaacaagtattgttttgtttttctttggtatccagtaaacttgcttcacattttggttggtacaggcagaaaaaagagagagaaaaggaaaccgaagatgaagtgtatgttagaatattttcttttatttccttgttccctacagtttcacaacttcgattgactgattggttgatccataacagcctcgaagatcattaattactaactctaaaattattcttcccgtgtgacctagaaaaagtgacataataagtgaagttgaagtatctaattctttatttattggtaagatgcatgcaaaaaataataacgcactgtgaataccacatcttcctcttctattagtaattgaaactacataaatacaacctcattttttgaagttgaagctccactttgagtatgaatcctggaaatgttaacgaggaattgcccttcgattcatcagcagatgcagacaatctggctgagtacacgttggaaggaaaatgggaaacggttatagacatgttttttattttattgataaatattaattttattagtaaagaaaatcgaatttatatataatctttttcctcaatcattgaatcctccttgtatctccaggttatccgcttgtacaatgaacacccagagtgtcacaccacaatgatcaaagagtccgcgggcactgcgctgcacgtggccatagatttgaacgaagaaggtgtggttgaagagcttgtgaatgcaattatcaatcacaggcagggtgagcgaagtgagaagatcaaggctctggtaattggggacgaccacggagatacccctctgcacgtagcggcgtccaggggattcgcaaaaatatgtaagttgatcattggaaccgacaatgaaaggatgtatttggcgagtcgaaaaaacaaacatggggagacgcctctgtttcaagctgctatcaactggaagaaacaggcatttgcttatctctctaacatttccaacaacagcgctcccttgcaagatcttgagcgccacaatggagacactattcttcactgtgctattaggagagaatatttcggtatgttatacttgtatctatcttcctttgctgctaaacattcatattttctgctttatgtgccactgagaaaattattaatattcacatgacaatattgatggttccgagcatgtcttgttggacgtttatatcagtaaacgcccgtgcgtcaagttgatgttaaaaatacttgctttaattttcataaattttaagatttggacgtgattttgcaagaaaacgagtggatcctatatgcaatccaaacacctataataatttcttccgcaattcaaaattcttccacgataagtattatagttataatgtaagaattaaatatgatgcagatgatctgatgtgaagtgatctgacaagatataaaaagaagtattgcattaatgtatatgataaatagttatttttattgagttaattattgttgatctaatggtggagggttcaggtacatggaggatttaggtaatttgcatgaattcttggtcaatgcacttataaggaaagaagagaaaaattgttgaaaatatcaaataatgagaggggagagaatgagaaaatcactttagaaattatagtttttaatttatagtagattcattgatgtgtactaaaatcataattcaaattaatttacgtgcactaaaattagagacaaaatgactatatattcatataatttatcaaataagaattaaatttgactttttttaaaaaaaaaatccaagttcgaatgattgagatttattaaggatcatttttttatttttttatttttagtaaattttaaataaattatagtttaatttaaattcagcaccagcatactaattttttaaaactttattttatatttttaattttttatttttgaaataacagtacgctatactgattactatattgttatatatggtgcagatttggctgtgataatagtgcactattatgattttcttagcacacataaaaataaagagggattaactcctctcacagtccttgccactaggccgtcagccttcagaagtgcaagcaaactttcatggtggaaacaaatcctgtaccactgtaagtaatataaactgcacacatcactagctagagtaaacttgtaatataaactgtaaactcaaaacaactactttcacacatgcatgagtgttatctgtaatgttttctttaaataactttaatagaaaaattgtaattaatgaacattgtatttcaattaatcatcaggtataaccaattttaaaatatataaattacttttgcacagtaagtgtatacagaaaaaatgtaaaaccaggaaaaaagatatgatgagaagagagaggggtgtgaaattagatgaatggtgtaatggagagataaagaaaaaatattgtaagttttttttttatgaatggaaatattgtaagaagtatcgcaaaaacttatattacatgaattatctaatttttttaaatgtgcacatttatgaatcataaatacgtacagagaatgtatgtaagagttttatctacctaaaaaatatatttcaattgattaatcataatgcgttaattattgtaaatcttgaatagtacttatgttttattcttgtagataattttttttatctactatataattttcttattttgtcataggtatacttgtagcaccactggagcctgaaagtcaaatgaaggagaacttgagaaagatggaggatcctaagtctgataaaatgaattatccaaagaactacgccacattatatgatttctttgctggatcgttgagtgttgctgctctaattggtatgtaaaggggttctcatgcatgcttcccgtcttttttttttctttcttcttttatctcatcactttaatgttttctttactaatacttaatatttactgaaacatattttattatatgtgttcatagacattggttcatttcagcaaaagggataacaatttaacttgatcataaagaaggaagcttatgatcagtgtgtttcataagacaaataagttagtttctaatttattagaatagcttaaaaacttattttactcaaattatagagttgcatgataaaataacttatttcattataatgtttttgtaaaaactagttggaacatttagatttttttcttcttctcatttttgttttttgttttaggggtactagtttctcaaaagtctatctatttcttaagcatttttcttttggtcaggaaagatgccttcaaaaaataatcagcatgacgcagaaaacccgtcaaccaacaagtgtacatttggatttggaactggtcaggttggatctttaccaccaaattatcaaacctttcaacaatttgtcaggtctgcatatgtacatactcttggtctttcaggagcgggtatgtatattctgaatgttaattttttgatccattgctagcttactagctagttaaatattggtcttgggcaagatggtttaataattaacacacgtacgattgtttttgtttcattgcacttgctttttaagaattaaaggacataaagaagacaaaaaagaggcatcaatggagtggtcaactcttgaaggcactactgaaaaggccttatgcagcattcacaggaagcgggggaaaaccaactgatatggaagttgcaccagatatgtataatatttatagccaatataaacaaggtatgtatgaatgtatataacacggagaatgtataacctcaaaattaagaggattaacagttctttcacatttgagttagtgttttatataacttttaatggtttttacaacatttacctgtgcttgtttgacttggcattggtaggtgaacccactgaattggggtggttggaagaagaaaagaaaactgaggctgatgacaaaaaaaatttaagtctaagtgagacaattagtaaggaaactgatcaacttgctgacgagaaaaacattgacaaaaaggagacagcatttttggttgcagcaagaaatggcatagttgaaatggtgaatgaaattttagatcgaattccaagtgtcatccacagcactaattcaaagaaagaaaatgtgttgctcgtggcagtgaagaacaggcaacccctagttgttgagagtttgaaaatgaaatcaaaacctgaagtttggaataacttagttctggcagtagatgatgatgagagcaccatgttgcatttggcagcatatgctccaggcggggataaacgttggcagatagctggttctgcattgcaaatgatgtgggatataaaatggtttcaggtatacccaaaacactttttttgtttaatatataatataatgttatataactgtagactcacaatattcagaagaaaaaaatgaagaatgtaagccttattttatagtgtattgggttagggaagagaaagagtaagaaaaagaaagtgatagatgggtaaaaaacgaagaaagaaatggatataaaattaggtatatagaaatgagagggaagaaactatagaaagagtaaatttatgaaatataattaaagaggaatgttaacaatatatttctcaaaacattcatttaattattaattgaaatttgttaaaaaatacaaaattataaaataaaataaaagacttatattttttgtaatctataaaataatacattattagcatttttcatataattacaagagtaataatacttacatgtatcaatatctgttatttatttttatctcttttattatcacatcgaatacttattacatctatatttttgtaattattttttctttgcaaaacattttcctaattataatatttatactaatgctgatgcttttgtttgactttggtgcagtatattaaaagccttgtgccacaacacttttactttagaagcgacaaggaggccaaaacagctggggaaatctttgaggactcacataaagacctcataaaggaaagtggtgactggttgaaggatacatctgaatcttgttctgtggtggctgcacttgttgctggcgtttcctttgctacagccagcagcgtccctggtggaaccaacgacgaaggtaagcctaatttagaaggcaagcctgcattcgatgtatttgccattggttcactcgttggactttgcttctcagtcactggactcataatgttccttactatactcacttctcgaaagcaagccaaagattttcgcagagatttgccactcaagcttcttcttggcttgagttcgcttttcgtatccattgctgcaatgtttgtctctttctgcaccggccatttttttctgattagtcacagatacaagatggtcctataccccatttatggagccacttgttttcctgtgactttttatgctgtggctcagtttccgctatactttgatcttctaacggccattttaactaaggtgcctcgggcaagtgataaaggggacaagttataggagcttctaccatttcattgactcagtgtggttttggattcatgtaattgttatacaaatcttttttggtttgttccttttctttttgagtcacgtttttgtttgtgtggtgtgcatttatttaataatatagctatggaaattaaaaagcttttaaattgtagcaaggctgtgttggttgtgctataaagtttgcgattgaggagaaaagtttctgcactcttttagggtaatgccttagataattttgatttcaactttaaagataatgttatatacttatactaattacacttattacgaaagttaattaatttaattattagtattaaatttatttataattataataactttttaaatttatttttatataatctattcatcttttttaatctttataggagaggaaaataaaaaatttaaaatattttagttaaaaaaattattaatacaaaagagaaataaaataaaatcttataataaagaataaaaaaattgttgaataacagacattattgtatacttaacttttgagtggcatacacattttctttttatagttaggttggtctgcagcagcaaaattaaagtacataagaaattattgtttaaccaaaaatttctttaattgtgtaccattacttacaccaattcggcaattctacaaacagttttcggtaacagtagccagctaattgcaacatcattttctttttattttcaaaaatgaaataaaaataaaacaaatattagaaatctactagaccaaaaaaactttttcactactttatataattaacagagataacaaaaaaatgtcattaatttactaactgagataacagataaagcgtcgagcttgccttcatggatataggctttctataacagatctcttttatctagagactcaaagttattagtataacattgtaggtttgtattatagacaattttgttattcagaaaattgatgtttatatattatcactagctatatcatactgtttataacaatttacacttttgtttgtgcttttaatttattttgaagcaagctgtagcaaagcctctgtacacaagttgatgattttaattattttaccttggaacagtatattaaaagccttgtcccacaatacttttactttagaaccaacatgaagggcaaaaccgcaggagaaatcttccaggatgcacatgaagaacttagactggatagcggtgactggctgaagtacacatctgagaattgctctgtcgtgacggctttgttgcaagtgttttgtttgctacagccagcaacaatatccccggcggcaccgataataatggtaaccctaatttagaaggcagtcctgcattcgatgcatttgccattcctacgcttgttggactttgcttctctatcattggactcgtaatgttccttgttactcaaacttcttcttgccttaagttctcttttcgtttccattgttgcaatggttgttgctttctgcattggcaattatttcctgtttagtaatttctaacacaagatgatcatattccccgtttatttcagccacttgtttttgtgtcactttgtacgtcgtatcccagttgccgctcgatctacgttgctcttcaagcagtcaatttttttaagatgccactggttctggtgaagaagacagtttataggaataggaggagcttctaccatatcattgttagagctgtattatgttgtacttaattcagagtctggtattatcatatcatcatcttcagcaaatattttttatttgatttgtcacttttccatttcttgtcacgtttgtctttaagcagagattgtggtgtgcatatatatatatatatatatatatatatatattataaacaacttttggattgtagcaactttgtgtgttggttgttgtggaatttaatgtttgcgattaaggatagaagtttctgcacattcttgtcacgtttgtgtttaactaagcagtgttggtttgtgtccaaatatattattcttaatttaaagttgacactcatagctactgactcagtccggttcagagtcagcaatttttagcggtttaaagtcgaatcacatgagtttttacgggtacatttgcacttttgatctgaatagctgaccgacctggtcactaatcttggtttaaccgatcgaatcggtcagttcgatcgatctgtgttctaaaactatgattttatacttaatttttgtgtcacattcacatttccattgtaagagctgatcctatgagacttttggtgccttagacgatctaattaaaaaattatgttttcataattatttgaatattatttgtatttttttcttgcaaaattattaataatatcttcataatcaagattcttttaaaaaaatcattttggtagaaatcaaaagcaaaattatttaagcaaataggattttaacaactttaattcaataaaattatttcaacaaatacaacattaataagaataataataatattatataacttgtacatgcattaaaaaaataattaaatatctttaaaaacctaatatcataaaccttgactttgattcaattatattgttaaaatttctccatacatttcctataatgctcttttgaaccgtgtttctatgagtataaaatcgtcttttaatgcacttttgtaatagtgaacctttccatcatatccaaaaaagttgaaggggtattccattattcaccaactacaattcggatatatagcaacataacaaatatagttcaaatgaactacatgaagaaatttttgggatgtacacctgcaaatgaacacacacacacacacatatatatatatatatatatatatatatatttcagtataatataacaaagctcacacatatatatacatatatttcagtattatataacaaagttttgtgggcttgtttgtggggtacatcaaaaaatccccagtactggcaagcatcttcaatctggtccagtgtggctttcctctcctcaccgttgagattctccaagttgatcacggggaagttgtccatctctccgcactttttatttattttgttcttatgagaattcgtaatgtgtttgttgatgcatattgagatgctaggtgtcatttatcaacattatcaacattaacaacacttttaatctaaattaattaggattgatcataaatgaatccaataatatatacaagaagattgaaacaataaaaaaggaaaataagaaaaagaaaagataaaaaaaagaagggaaaaaaaggagatgaaagataaagagaaaatgactaaaaatagatcttttagaatataaagataacaaaaagtttaaccatctatcaagtttataactttttttattctgtcttgagacttatcgtccgttaatctatatttcactctattaaaccttgtttaattatctttattcaaataaatttttatgtacttttttgtgtgtcatttatagaaatgaaaaaagagttaagtgatcacaacattgacaaattaaaaattctcccgtgtgccttatgaatcatgagatgcatgccacatgatcattttgcatcgttgaattgtctacttttggtatcgttggactcatctatggaggcgaaacaaccttccttgcattttcccttaaattgatactatggtgtttcagcacgtggtttcttcagtaggtggcattacctagcaaatgaagttctgaaagttattattatatatattatatgtaagctggaaaacgacttattctgacatctaacaaatacttaactaaaatagatctgccatggtattattgtatttgatacccacaaaatttacctccatctaaaattgattactatagcctacaactacaacttacaagcatgagaaaattttcatattgttttgggctgaggttgtaccatgtaattgtctttcattaattttgcatagcgtgttcgattttttatttcaatctgatttttcaaatttattaagaattttatcgttatagtttctaaaacgttttcttaatttctaaggtttttcccaaacgcacatgccattaattgaataagtaagacaatccagaaaataattagaaccaatagcttacaagttattacaagcacgaaaaaaattaattgaaaattatatctggacaatttcttttttcaaaaaataaccattgatacaaatttaaaaagaattaagaaatatcattatctgaactagttgcctttttctattcctagctttgaccactagagcaataggagccacaaaaaaaaaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaacaaactgtggcgtctaactgataggacatttctgttctacaattccaagtttttgagaccaatgggaagacgttggttttggtcagaatatatcttggccatcgcggtcagttgatcatctttatcatgttttttgttcttagcaacaaaaaaaaaatgaattaagtgtgttaagtccagcatttaaattgaatattgtcaaaaaaactatggaacaccggaggctgccacggtatgcgtaccttgtacgttattaattgttgagactgcggaaatcataatttttaaaattgaattagatcgtctctcgactagtctgatcgaaaacctgtttacgtgattgatcttttaacttttttttaaaaaaaaaattggaagattttaaaactggtaagaatcattcaaaaatcgattaaaccggattaaatatagtgaaaaaaaaggtcaagaatcgatagatagataattttgatttgaacccgcattttcatttttttattaattttttaaattaaaaatatttaaagataaaaaaatacaatttaataaaaataaaaataggtgcaaattaatttatcaattattattaatttcttcttataaaacatataatttacttatttatatgaatttataatttttatatcttaatttcctaagattttatattgtattaatttgtcattttattatttattttagatgtaagtttattattattaactgacattttgtattttactaaaatttaaacttaagtaatactatttgtttgttttatttatactttgaatgttataaatctataaaatttatttaagctttaattttttttagtctatgtaatttggtcattttggttttttagtcctagaaaattatttcagtcattttaatccctaatttttttttgtatttttaattcctatcattaacgtcagtcccttaaaatactacatggcaaagagtgtaaaattatcatgtcatgtgttgttcacatggctctatttctatgatctcttttgttgacgacattttttccaacacaaatttctaacatgtcactgagaccaacaacataattcctttattcagtcattatatgacttcaattgaggcctaaatcagttcgtattatggtagcttttgctcaaaagtttaattttgaaattcctaacaaaaactccaagcacatgaacataattgattagcctaatccaactcaatctaacaaaacaaactctgcagcgggctaagcccagattgagaatcatcaaggagtaggaaaacctgaagcatctctgcatatgaagtatggaacaaaaattttagctcttttttctgctttatatctttttcccactttagctcagttacagagatcataacaaggcgcaaaaaagagaaaggaattccacagctacgaatgcaacattccagaaaaggaaaagaaaactgaaggtgtgttgcacgacatccatgacaactgaagtgtgttgcacgacatgcatggcaacattccaaaaaggggaaatataacatgcacgacatacaagaaaaaagataattgaatgaaacaagcaaagtaattacgtttgatttttctttgctggtaattagctacagtttcattggtctcattcatagcagtctcgatcaacgaagatgaatactactaactaaaattattcttcccgtctgacccgcgaatatttcggtgtcttatacttgtgcggcgccggatatgttatggcccttgtgggaaacaataaacaaggatctcccataaatttaagtattataaaatataaatatatatttcataaaaaaataagtacatatttttattaaaaattgtatgatttattgcatttaactagtgattaacaaaattttaataaattttaaaaatatgaattatcttttttcttcaactaattcttatatacacctagaaataatcaaagtttaatatttactactaaaaaatatatttttaatatcattttttaacatcgattttataaaatctgatgtaaaaaaaaaaggacagtgacataattgtaaataggttgattttgttaatatcaatttttaaaaaattaatgttgtacatcgatattaacatatggtagcaaagtataatggtgaatatatggtagcacagtataatggtgaaattgtacaggaacatgggcaaaagataggagatgatttacatgtatattgttcatgctttaactaaacttatgttataccaacgaaatgttttatcaagaagagacatgcctatttgattgattttttaaaagcttattggaaattgcatagagcgtcttaagctaatttagatggatgtttttttaattttcacccccatcttccaaaaggaggtacttttgttcaaggaccaactattctagaagcaggcacaggtctaacagtggttttattgttaatacacccttcactgaatagaacttttgattgaagtgtacaacttgatagcacatcaaagattggagggtcacaagtcatgaaaagattttctttgaacttatattgttttgtgatagcattctcgtatatttgatgcatacaaacatggtaggaggtttgaaacttagttgagattttatccttcatttatttataaataaatactttccaaatctataagtttaacttagagaggaaagattatgaacttttttcaacatgtttgtttaagctatcttgcagaagcacctgtagcatgcatgcaaggagaaggttcaagttcttttaggggtatatgctttctattgaaggtgaagatgaacaaaggtagagggttattgctaaaacatacttttgtgtgtgtgtgtggtggggggtggtattttggagtatgagtagcttttgcttaatttacttctatattacaggcccttctatatacactgtttgctttctactacctatgttgtctcaaattactatggagactgaagaatgcaaagctttggcttcatgtaaaggacttgaggccgtaagttatttctggttccaatgcttatattttttattttacattcttcatttctcctccctttttttcctgctaatttcttttaaaggtggatccgtacgtgtaaatcaacaagattctaatgattggtgtatagtttaatttaatattctagcattcttttacatttgttgcaatggcgtcattcaataacattattaacaaagcagtttttttgtttggctaaatatattggatatatttgtagattttagattaatgcttcagtaaattagttgggtcacatgcttttctggttgaggccggataatgcttgcatctttatggcgtgtgatacaataatgaatcttttattaaaggtgagtttcttatcataaatcagccttattattctatattggttttagttgtgcaaaatcttattgacataagttgcactttttttattctagaaagacaaagttcagataatgttggatgtatcagctattgttgatcttcttaaagcgttggctcattggtcaggtaccatacttgttagcagccattaaaattagtttttattgtgctccattatgtgatcctattcctttctttttcatctacttgtttgcttatgcatgtttaaaaaatgacacgtgctcttgtgcagctgtattagcatgtatataaaaacaaagtggtttctatgtcaagttgaactccctttgtaccttagtttataataatgagcttaattttaattcataaacatcttttacattattattatctgattacttgttgttacaacattaaattactaggtatttacattatattgttaatgataatattaatattattatcatttttaaattttttgcaaaaagcaacattgatttaaaaccgacgtagaaagtatttttttcgcagagatttgccgctcaaacttttcttggcttaagttctcttttcgtacccattgttgcgttgcttgtttctttctgcacgagccattcttttctgttcactcacaaatacaagactgtcatattccccatttatgtagccacttgctttcctctcactttctatgcggtagcacagtggctctctactttgatcttctaacagccattttatataaggttccaaaggcaaatagtgaaggagacagtttataggaggagtttcacccatgtcattgttagagctatattgttcttaattctgtgtggtgttggattcatgtcattatcatatcatgcgagtatttgatttctcgctttcccatttcatgtcacgtttgtgtttaagcggagagcgtggtgtgcatttgtgtaataaacacatattatgagcaacgaaagagcttttgaattgtagaaactgtgttggctgttgtgttgtgtaatgtttaatttgcagttaaggggaaaagtttctgggcattcttggtgtaatacctctaataatcttgatttcaactttaaagttattgttgtgatttatactgaacttttgtgtcacatttacgtatcatgattatacgggttcgactaacaaagtccagtacaattggtaaataattgggttcacatgttgtaaaggattcgattcctcatcatgtgaacaaagaaaactttgtctggcgacacaaaccctactttgacaatctttatatgtcaaaagaaattagtcttgaaggacatcttgttgcaaataaaaaaagaaaagtaaattatatgggttggtttgcagcagcaagaataaagagtttctggtttaagctcaaactgtaatccattagttaaaccattgctacaatgtacaaacagtctttgatcgtagcaggcaatttggaaccttagttcttattctcaaaaataatggagtaaataaaagatctagaaatcgactagacccaacaaacgagacaagggaaaaataattcgtaattgcttcttatcagaataattcattatttattaaaacggaagtaattaaatcacctgttgtaataagaaattgaataattagaatacaaataatggtttccccattgctgttttttgtcttcaaatttccaaatcaataaaatttttgtggcagtatattatataggtatagctcctgttaaggtgtgatggagttggaaatactctaaaatgagttcactcccttcatggcttcgaatctgggctccttaggctggaacttgagtgtagcatagagcttcatgtaatcctcaaatacaaattttgggtacacttgttccgtctcttctgcctttgtctctaacaatgctggtgcagggtagataagagcatcactggcagggttgtagaatgaggctactgacattctggtcccatcagttttagcaatcacacgatgctccacactcttgtatctcccattggtaatgacctatgatattagaccaaaatgttgaatgaaaattactataagtacagtgttatgctttagggacataaccattattgaaagaaaaaggtacatacctcaatttggtcaccaaggttaacaacaatggaatggcgcattggaggcacatccacccattggccatttttgagaagctgaaggccactgaccttgtcatcttgcaagagaaggataatcccacccgcatccgtatgtgcacgaagacccttcaccaactctggctttgggcattcagggtagtttgctacctttgtcccaaaatttggacctcttgatccataaaatgcattcttcaagtaccctttctctaatccaagattttcacaaaacaggtctagcaactcctctgctagtttctctaatttctgtgcaaattccttcattgcatccctgcatcattaattcatctagtttagactatgtcatatgtagacaatgctatgtatcaatcatgttatcatatagttttcgatttgtcataccggtagtcttggctgagatcagggatttctgagatgttggaggttgggagatggcgcaagaagaaggtgctctcccaatccatgtcctttacttcagcttctaacccgttgcttgacactgcctccttgaacctcttctccatgcatttcctataatgctcttttgttaaactttccacagtatccaaaagttcaaggggtattccatgattcaccaactacaatcaggaaagcagcccaattaacatatataatttaaatgaacaagattacgaaaacttaatgtttcaaatgtatagatataaatttgagttatgagtatgacagagcttttgtcagcaagtttgtggttgtggggtacctcaaaaaatccccagttctggcaagcatcttcaatctggtgcagggtagctttcctctcctcgccattgatattctccaagttgatcacagggaagttctccatctctcaagctttttctttcctttgttctatatgagaattcttgatgtgtttgttgatgcattttaggatgctaggtgtgtgcaatttataggaatgcaaagagttcagtgaagacaacatgacaaattaaaaattctcctgtgtacctcatgaatcatgagatgcatgcttgcttacgtagttgaattgtctactttggtatcgctggactcatctcatggaggcgaacccaaccttccttgcattttcccttaaattgtagtactatggcatttcagcacgtggtttcttagaatgtgacaccatcaaatgaagttctaaaattatttatatttaggatattgttaactaatattcttaagatattaattaagaaattaaaagagaaaaataattattacataaatagtaagagaagataaaaaaataatgaataatataatttttttgtttttcaataaaaatatttatattttaaatttcttaattaatatccttactcactgctaggatttatcttttatttattatgaaagcttgtgaactccttattctggcatgtataaaattattaagtgacaatagatctgccttgctgttattgttctaaaattgactagaacctatagcttataattttcaagcataagcaaaatttcatattgttttgggctttggttctaagatgtaattgagtttcaacggtttctatagcgtacgttattggatttatagtttagatgtagtatttcatgttttttttttttttatataaccaaagtctttcatgtttattaagaagcttgtaattattgacttattgcattctatatttcaaaattcaaacataatttcttacttcccaacatgttttcaaacacatgtttagtaattagacgccattaattgaaaattataactggacaatgtcttttttaaaataatgattgatacaaatttaataaaaaggaaacaagatatatcactatctgtctgtactagttgtgtttttcctttcctttcctttaaccactatgccaataggagccaccaaacaaagataagctgtggcgtctaactgataggacatttctgttctccatttttcaagttagtttttaagacaaaaaatgggaagacgttgattttggtcagcagaaatatatactatattcatattcctactcatcggcgtctctttggtcttcatgattcatcgtcatacttttttcttggcacaaaaaatttgaaccaagtctcttacgacatgttaggataacaaaataataaataaaatgatttttagtaagataaaattaacttaatataaattaatgtgtagaaaagttgagagatcagcttctataaattaatttaaacatgaaagatcagtttgtagaaaagtttttctttttcttttaaaagtatttttgaataaacttatcaaacaaactgaactttgtcataagttcaacatgtaaattgaatattgtcttttaaccatgggcaactagaggctgcaatgtgcatgcgtactttgcacgttattattgtgatgtgtgtgaaaattaccaagtgataatgaaataacataagatgctaaaaaaaaaagaaagtcaaagaaagacgtgcttaataatacattttatttctttattttcatgatttcgtaaatttttcgtctcctatttttaaaattctggaaattttattactatattagttgaatgttcattatcgttaattgactaataatgtgatggtatttattattgactttatattttgatattaacatgataatacacattacactaatacggatcattgaatggcattattgtgccgatctacatgcagtaaggaaaaagtgtacagaattttaaacacagaaagataaaatatgtgaaaatattcaaaattaagaaattaaatctgtgaaaattataaatggttaaaataataaatgttaaaaatagaattagaatccacagtcttttccaattccactatcacttcaggtactaagtcacttgaccttttttagttctaaataaaaattattttatggatactatcgccgtatttgttaattgcagatttggtccctcaaagtaataactattgtgagaatttaattttgctaatattaaaattttattattttaattaaaaatataatttcgtaaaaaataaattacttataaaaataatttataataatatatccttataaaaaaataaaaattgcaatgatgtcccacttaaaaataaaacactttttttaaagtacaaaccctatatttattgtatgaaaaaaaaaaactaaaagttaagacaacaaatttattttaataaatatttttattttaattaaacaaatttataatttatacaatttcattttggcaacatgctggcctctagaactctatagaagctataataaactcctcggatatggtttccagcatcttatgttcgaccttctccatactcttcctcagcaaaaaaacaaaaacattctactttgaataataaaagataatggtgtattttatatattaaaatatttttatattatttttttatagtttattaaataagtttatacaactattttttacaataacacttttcatatattcgataaataaaggccatttgattgtgctaaaaaatatttatttaataaaaaataagtggtttatttttaagagggacgcgtattttaatttcaatttttttataagaacatattatttaaatattttttatgattgattttttaacagttatattattttaattttaaattaaataataaaaattatattagataaaaaataaattccccaatggttatactttggagacgagtagaatagatactaacatttttatttatgaattaaatcaaacatgtcaaatatattaatttacttgactttgataatattatctgtctcatgataattattattttaagttattttatacagataaaaaataattaataaagaaaagagaataataattttataaaattaatcatatatcatcattaatttatttataatttttattatctaccgttgatataataagaaatataagtaaataataataatattacattaataaaaagttaaaatggtaattattttaaaatattttttctacaataattataataaaacgggaaagtaatagaatatgaagattaatctcacctctaacaattttattatttattaatttttgtacagtttgcctcttcaatttcaaaaatttgtgcaatttgcctctaatcgcacgtcagcacgtcattattattatttatttattttgttgaactgaaagggcacagccccaggaaataaacgaagacacaaaataaaaaaacttgtaccatacctcgtggctgtaacccgaaattggctagattatcagcatttcattgtcatgtcagtgctatataaaactatcgcgtcaggagtcaatgttaaattactgtgacgaattttgcaaaattgttaaagtaacgaggaaaaatgtgtaattaaactaaaaaattatatcaaccagaaatccagaatagcgtcatgttctagttatacagtggcattttaatcattgaaataaaacgaattgaacgattttattaaagacgaaatctaattttgacaagaactgtctagagaagccttaatatttaatttccttacaaaaaaaaaaaatggaaatatgctagatttagacccaaagaagatagtagagaaagaacagcagaaaaaaatgcatattatttgtataattttggctatttcctttaccaaaatacaagtaatcaaatcacccgctgtaacaagaaattgcatattaaataaacaagcttaattactatttctttcaaattttatcagttaataaattttcttcatgcaattgcaattggaagtaatctaaaatgagccaatggccttcatggcttggaatctgggctcctttggctggaactttagcgtagcatagagcttcatgtaatcctcaaatacaaattttgggtacacttgctctttctcttctgcctttgtctccaagaatgacggtgcagggtagataacagcatcactggcagggttgtagaatgaggctacggacattctggtcccatcagttttagcaatcacacgatgctccacactcttgtatttcccgttggtgattacctatgaatatgatattagaccaaaatgtcgaatgagaattactataacagtataactacaagggctatgctttaggggcacaacaattattgaaagtaaaaaggtacatacctcaatttggtcaccaagattaacaacaatggaatggcgcattggaggcacatccacccattggccatttttgagaagctgaaggccactgaccttgtcatcttgcaagagaaggataatcccacccgcatccgtatgagcacgaagacccttcaccaactctggctttgggcatgcagggtagtttgctacctttgtcccaaaatttggaccctttgatccataaaatgcatttttcaagtaccctttctctaatccaagattttcacataacaggtctagcaactcctccgctagtttctccaatttctgtgcaaattccttcattgcatccctgcatcattaactcatagttcagaccatgtcatgtgtagatatgcatcacattatcaaatttgtcacacaaatcacacagttaattaatgcagcattgttttgtcattgttggagtattgataatgaaaacataattatataatatatatgccaatatgccatcaacaatatttcgttatatgccatcagcattgttttcttagttttcaatttgtttttacctatactcttggctgagatcagggatttcggagatgttggaggttgggagatggcgcaagaagaacgtgctttcccaatccatgtccttcacttcagcttctaaccctttgcttgacactgcctccttgaacctcttctccatgcatttcctataatgctcttttgttaacctttccacagtatccaatagttcaaggggtattccatgattcaccaactacaattcgggatatatagcaacataattaatatagttcaaatgaacaacatgaaattttttttgggatgtacacttgcaaatgaactgatatatatatatatatatatatatatatatatatttatcaatataatataacaaagctttttgatcaggttcgtggggtacctcaaaaaatccccagttctggcaagcatctccaatctggttaagggtagccttcctctcctcaccgttgagattctccaagttgatcaccggaaagttctccatccctcactttttttctttcttttttgtcttctgagaaatgttaatgtgttttgttgatacatattgggatgctaggtgtgtaccatttataggaatgcaaaagagtgtgcagtgaggacaagtgaaattctcccgtgtgattcatgaatcatgagcaaatgaagccaatctatgccacgagatcattttgcatcgttgaatctggtaccgtttgacttggaggcgaaaccaaccttctttgcatcttcccttaaattgtactaaggcatttaagcatgtggtttcttagaaggtggcataagcaaatgaagttctaaggttttaacagcatttatgttattgttattaattattaaagaacgatttaaaaaactgtgtgaactgcttattcgaacgtctaaagtacttgtgtaacaatagatttgccatccgattattgtatgttgtacactcaaaatctacctccatctaaaattgattacaacatagcctacaagactttttaactaaggtagtttttgaaaactatttattcaaatagtacgagaacaattaataggaattgtcttctgtttttgtcttgtagaggaaaaaattagcctgagtgatgcctccaaagtgatagttattttcaactttttacatcaatcatacatacaatcaaatataaattaaaagtaaaaaataacttacaccgtcatagaataatagaggataaaaaaagaatctttttagttaattgtttttttttttcttcacccactttgttaaaaaaagagtccaagttagaagtctcaaaaaaaagaaaattttcataattcaccaaaagaagaaaaaaatcataggttctaagatgtaattgaacattaacaatgtaattggaccccattagttgaaaattatcactggacaatttgtttgctgaaaaatagttattgatacaaatttaaaaggaaacaaagatatatcgctgtctaaactagttttctctttttggatactttcaccacttaactaatactaataggagccaccaaaataaagataagctaaataagctattaagctgtggcgtctaactgataggacaattcttaaataagtttttaagaccccatctggaaaacttttagtcaaaatatatatcctgttcatcggggtctcttcagtcttcatctttatcatagttttttctcagcacaaaaaaattgaattaagacttagactcttcagtcttcaagtccaaatgtaaatcgaatattgtcttttaactctgggggaaatggaggctatcacgggtatacgtactttgtacgttatttttgtcacgtgtggaaataaaccataagaatgttagaaaaggaagtgagagaaatatgtggaccaaaatagtagtctcagcctctcaggttcttgttacacagtgccatctaagtggcgctcgagtcagtttatttttgtatttttaaagagaaattaagttaaatatatttgctgaaaaatcttaaaaattagtaacttaatttttattaaggaaagaaaaaatatttttaaaataatttttttttctcttttttcttttattttttctctactttgttttagacatttctttcaaatcacaaagatgaaaattatctacaaattctactttaattttaaacttattatttagattcttaatttgaaattttaattaaaagaaaaatacactagacatgtcaggttcatgccattgctggtggctgctcttgacacttgtcaaagttagatttcttctttctttcaaatgggcatcatatagttaaatttgtaaaatctcaataaataaagttatacaaaaattgtaaatgtgtgagtctaaataaaattgttttataattttatggaataacatatttaaaacttaatatattgtatatctaaacatatgactaagaatgaatcatgataataaaaaatattttactcttaaagtagtaaaatattgatttatttttttttactatttagggacatttttcagctcttatcactaatatgtaattaatatagaaaatcataattttcaagctattactacaacatagcaaagattaaaatgtccaatgatatggtcttgtgttattcatatatcataaggtgagaataaatattatatgttaaaagaaacttttcaatccactatttttatcttaacataaaaatttattagttcatgtcaatttgagggagattcttggcacaaaaaatcatcatttctattttttctttcaaataaatgatgaaaaattgatatttgtatctgattttatttcaatttccttcctctctatttttatagaaattagaaataaacaacgggtagatgagtaaccttcaacttttttgtaaaatgtatagaatcaaaaacgaaaaaacttatttttttaatgaatttgttggttttatttttcattggagaagaatgtccgcaatactgaaaaccactttgatgttaaatggtgttttctaagatgttctgatcctcctccatgagacaaatggacatcatttaagtgattttgcaaatgaactgaaatcattcgtctcacattgtatcttatttcctgctcctccaattaaaactctccatctcaattaaaaccctccaatataataatgtagatgtaattgattgccacttaagtttatgaaagtattaaaatttcaaaaaaccttatttgtttgtttgtaattttatttttatcattaaaagacttacattaaaatacatcatatactgtctatctaagtgacagttaacaatacacatatgaatgacacgggataattcagtctgtacgtaataattgatgacatatgcataaaagttcattcagagatcaaaataacaataatggaattctcacttgtcattcatgcataactaataatatatatatatatatatatatatatatatatatatatatataaaaactagtgatgaacaccccagaccattggcaacttgcagccttaatatttagtttccccaaaaaacgaaataataaaaattattggaaatacaagaggtcaagatacgagagaaagaacattaaaattgcatattatttgaataattctgttattttgctttatcaaaatacaagtaaatcaaatcaaccactgtaaacaacaaattgcatcaataactcagcaacatttccaagcttaatttctattgcttaattcttttcatattttctcagttaataaaatttattcttgaaattgagcagtcgtaattggaagtaatctaaaatgagccaacagccttcatggcttcgaatctgggctccttaggctggaacttgagtgtagcatagagcttcatgtaatcctcaaatacaaattttgggtacacttgttccgtctcttctgcctttgtctctaacaatgctggtgcagggtagataagagcatcgctggcagggttgtagaatgaggctactgacattctggtcccatcagttttagcaatcacacgatgctccacactcttgtatctcccattggtaatgacctatgatattagaccaaaatgttgaatgaaaattactataagtacagtgttatgctttagggacataaccattattgaaagaaaaaggtacatacctcaatttggtcaccaaggttaacaacaatggaatggcgcattggaggcacatccacccattggccatttttgagaagctgaaggccactgaccttgtcatcttgcaagagaaggataatcccacccgcatccgtatgtgcacgaagacccttcaccaactctggctttgggcattcagggtagtttgctacctttgtcccaaaatttggacctcttgatccataaaatgcattcttcaagtaccctttctctaatccaagattttcacaaaacaggtctagcaactcctctgctagtttctctaatttctgtgcaaattccttcattgcatccctgcatcattaactcatctagtttagactatgtcatatgtagacaatgctatgtatcagtcatgttatcatatagttttcgatttgtcataccggtagtcttggctgagatcagggatttctgagatgttggaggttgggagatggcgcaagaagaaggtgctctcccaatccatgtcctttacttcagcttctaaccctttgcttgacactgcctccttgaacctcttctccatgcatttcctataatgctctttggttaacctttccacagtatccaaaagttcaaggggtattccatgattcaccaactacaatcaggaaagcagcacagttaattaacatatataatttaaatgaacaagattaagaaaacttgatgtttcaaatgtatagatataaatttgagtatgagtatgacaaagcatttgtcaacaagtttatggtggtggggtacctcaaaaaatccccagttctggcaagcatcttcaatttggtccaagatagccttccttttgtcaccattgatattctccaagctgatcacagggaagttctccatctctcaagctttttctttctctttttccctcttagtaactatcttagtttgtttgtctgtgcagatcaggaaacaatgtgtgtgctatttatagaagttttaagtgtacagtacaattaataaatagtaagtattacaaatcgtgtttgactagttttaaggcatttgaagaatcatgaatggtcgtgatcatgaattttgcgtcattgaattgtcttctttgacgtggccatctaagcctttctccttgttagagtttcttcatgtggtttcacagaaggtggcaaacttcaccagctatgtagaggtgtaaaaactaccaacccctgaattgtaaattttcatagtttcggaaatgattggcctaatataagtttgaattttcttcttcactcatctcctttacttcctattaaataagaaattatttggttagggctgacatcatttgttaaatattgaaaaaatatatatttgttaaaaaaaatcagtagattttggtataaaaaaacaaaaacatgtaccgttcatggtaaaaaaaaaattcctacttaagatcagtagaatgaaaaaccttttataagttgatccacacccattaagtagattaaaataattattgtatttaacaatttttatttttcaaatgacgcaatcaatcattgtttattttactgtaatacttttttaaaaaattcattgtttaattggtattacacatttgcactattatttcacgtgtttgaattcaccttaatattaattactccttttgtccctatttataagacataattaaatatatttttttgttttttattataaaattttatttcatttctcttgtgcattaattattttttttattattaaaataccttaaaatatctccttctctcttttatggaaatttaagaagataaatagatttttaataaatttaaaaatattaaattatagatgaatttaatattaataattaaattaattaattttcttaaattattgaattatgacttataattaagaaggaatggagtaagatttatatacattatacacaaattcaggagaagcgtggggtttccctaactgaaaaaacgagttgcaatcacatcaggatccattctcagttgttcgccatttaattagaagtcattgtgatgatattgttggatatcatcacagtcgcaacttttgattagttcctcaactactatcagctcacgggtgaaatagaatttttcatttacttccttttcttatgtcgacagttttttctttatcgcatcctcgctattgttgttcattaaatttttagaagttataagattttatatttaggatttttggatattataaaatataagaataaaaagacataatcttgatgaagtctaaaatttaggatttcaaggtacttaagtaaagagttatttcaaaataaattatgtaaatatatctttgctttagaacacgagaacgatgcatggaggttgaaatatatattcaaggtttttaataaaagaggtattataaaataaatcattaaatacaaatcataaaaatagaatcttactaattttaaggagaactacttaatttcatgaacttagaatgatttttaatctaatttttatattcattttatttttgttatcaagctcgtctcaactaattacaaaaattcaaagagtaaattacaattgtgtctcctgtgttttgctcaactttcatccgatacttattcctttttgcaccctaccaaaaatttcttaatgatttagttcacattacacttagtcatccttcttcctaacatcgtttaataatctaatagaaattaaacacatgctggtcacatgacttttaatgaaattttatatctaaaatccctcatcttcttcctctcaaccagaaaatattttaagactcttgtttcttttttattttttctgtaattggacgtaaacccaactttttattggatgtgaacccacttttttggtacatagtgttaacactcttccccattttcagcacatcatgatcagtcttaagggacttgtttacatagtcatatattccatgtattccagttcatccattatgttcatgtgatcccaaccatcaacactattttaatcaacaaaaataaacaaatgatttttagttcatccattgtgttttatgtggtcctaaccatcaacactattttaatcaataataataaataaatgattttaaaaatcataagtggtcccaaactggtccccattgaaaccccattcagaaatagataacaattaaccatcaaaattaaataaataatcttaaaaagtaatttatatacaaggtcagtggtcacttataatcataaccttagcgtgaacagaaatcgtgaaataggaagaagataaatagagcgctcgtgaacgtcgaagaagaagacaaacggaggcgttcgtgaacgtcgcgagaactggaaaaggaacagtggagaactcgtgaacgggaaaaggaacaatgaagaattcgtgaacttgaacaagaatggtgaataactcgcgaatggtgaataggaattgaacgaatgtcgtgagagaaagaggaactcgcacctcctagatgctcaagaagaattcgccaacaagaggaagacgaacagcaaatggtgaagagaaatgaaatgtgaatcctaaattctaaaattaattgggagagaataatttgagttttacaattaaaatgtaaatactattttatctgctcacatatttcaagtgacgttaattaacattaacagtattaacagaagaggataaaagtaatgtgtaaaaaaaaagaaataatagataaaatttgagcaaaacatagaagatggtgcgagtataatttactcaaattcaaattcaatgcatgtaacagggattatctttggtccaatagtcgatccacacgaaatgattaccaacaaagattattgcaaggtgtgaaaacttattggtataattaacaagtaacaattgacttaacaagttattgcatatttttgtttggtacaccgtccacacgaaattttactttatttattttttactagttaaattttacttatcttgtgtaataaattacactataatcgataaaatgaaaccatagtaaaagttaagtatttttaataagtttgttaacctctatattttacagtaaattttggttttcatctttataaacttttttttattagttttaatctttataaattttcaaagtttaaaaattaatttctttgatatgtgtttaaataagatatattacatgtcatttcaaaataatagttggtgtgatatatttaaatacatttttatattattattattatggtgataacttttaggataaaatatattttggaaactcattaaagtttgaaaaatattaatttgatctttattaaaaaatttattaatttgatttttataaaaataaaatttatttttttatgatttttagtgataatttcgttaaactgtaatatgacttgactaacaaacttatatatgtaatttaattataaataaattaagtaatttattgtggttaaaatttcaaaattaatcaaacaattttttaggctaaaaatcctcccaaaaatataaatttttttgtttctttttaatgagattaaggagaaatatgatgcaacaataagttttgatattttcttagtgtacttgagaaaaggcaaaaagagaaaaataattaaagctatcagtcacataaaaaaatgtctaacaaagttactattaagaattaagaaaaatatattttattttgatagaggtgaaattagtactatgaataccaaattaatactttttaaattttatagaatttcaaacatatttttccctaaattttatataaagaataaagttatgaaaattaaaccaataaaaatattttataaaaagattaatatatttacagatataaaaacatatttaaggtcctaacaaaaaatgaaattgtttgggccatagtttagccgtcttaattgaatttaaacaatttgacatcgtttaaattggacggctggaagccatcaatccacacttatcacaccaaaatcactctctttttttcctttttctttctcctaatcctcgatataattttacttaagaagtaaacttgatatgattgattgaacatagaaagtcaagaagagaattattacttctgtttcttttcttttaaccacttgaccaataggaggaaccttgtgccaaagtaacaacaaaaagagtgtaaactaattccaagtcagattcgagaaaaaacgagagaaagtagtttagcacttgttatgttattcatttaaattgagtagttgccaaattatgtttggctttggcatctttaaaccgagtaagaataaaataaaactacggtgttattcttaatttgttaaattttatggtaaagtttcatcttaacttatttatttagataaaaagatttattctcttcataaaaaagaaaagatagaatcaatacagagtggttttagctttaaattttatgaaagaacttaccatacattcaattttttacttaatttgtctcaataaatgtcattgttagttattagaattgttattattagtagtaagatttattgttattattttattaactattattgttttacctttcctcaatttttttttattgttgtaccttttatttattagtcaaagtccaaaaatcattaaagacttcattctttaaattttctacacacagctaaggcatttagccattactccattctctttatttttttaatcagtaaaaataaaaaataagtatcaaaagatttataatatcttacacatgatgtttaatcaattaagttgtcattattattactagtattattttaattaattatttattgtattattattttgattatattctgatatccaccttccggcactttcgggacctctcttcatctaaaaattgaaaatttctctcaagccaaagaaagcactcttacttgaatctcatgcttcccattctgaagctttgaacttggataactctaatctctctctcgatccagcattaacgtgtacatggagaataatttttcatgtttatatatatatatatatatatatatatatatatatatatatatatatatatatatattcacttcacaggggcacataggtggaagtttcttcaatttgatattctaaaaaaattaatttcacaagcaatagcgtcatatcaaagattggtgttaacgttgggctcaaacgggtcagcccatcaagaaaaagagaaagaacttatgggtctcaaacttcttagtccagcccaaaacaaaatgttatactaactacttaggagttaggagaggaatagtgataaaaatctttgtcccataaagaggaattttagcttagttaaagtttaattgcaatagaattctaaaagaaaatattaattaaaataatagcaagcaaataaaactctaacttatttatttgtgtaaacaatcaaaataataaaaataggatgtcacattattaattaattttagtatttttctaatcttacgcataagtttataattaattttaaaaaagttctttcaaaattttatcttagtaaaatataattttgaaaacaattgcagacattgagactactatttattatttgaaataatattatattttcatattagagaaactgaaaaaagagagaacgttgcaattgtgtaaaaaagtaattttaaaatatttaatgaataaaattaatattaacaatataaaaagtaaaaattaaaagaaaaatataaggatttaaaaaaaaattggctttaaaaatcttaaaaataaataaaaataataatgatgattaataaaatataaaatattattttaatataatctaattagacattttcttgaaatattggagcttttattttggatttgtaaaaaaatatatactatcatctaataaaaattgtgcgataaaaaactaataaaatattttttaaaaattaataaacttaacttatataacaatttgtgatttaataccgacaaactgttttatacttttaattctcaattttttctccatcactttccattagtcgcataaaaaagttgtcatatactaccaagtactaacacacttttatacagacaataataaaactcacttttcacctttttacttttttttatagaatcttattaatcagtgtcaatcaaatattagttaaatattttaaaaaaattatataagttataaaaaaatcatgaacagtaaaaaatttcacatcttaatgaaaatatttcttattttattaattgtaaacagggtaaaattaaacttgtcaatctattttctcttggtttagtcaattaattaaacaataatgaacagaatgaaattgtgaatcgacgacgtattttggtgcgtgcaggtcccggtgtttgaattggggtttccgtttcgattgtacctaccagccaacttagggttcagtcactctcgatctcaccgatcaccaacgtggcttctcctcctcaggttctctctctctctctctccccccccttgcttaaatcattctttctctttttctgttacactgattgtttatattttatcgtatgtttttattttttttttattttaatttcgtatgttgagggtgcaacttgttgggactgtggattggttagggatctgatgcgtttgtttgactccgatccatttttcgcggttttcgatttccagacactcaacttaatgtgagatttctaggcttgttactcatgtttctattcgtttgattaatataattttgttggatcgtggagattcttcatgaacctaatcccagagaatggaataaaaataataattaaaaactacgtatctcattgcgccctatgctatgcacaaataaaggggaggaatattgtatgcagtcttatccttgcatatgtaaagagtcaggaggcctaaagcttgttttgggtttccgataattgggtaattagtttgctcctcctcacttttggtggcaaaatgaacatgaagtgaattcaaattgagacagacatggctgctgtggtgacaaaggtggatttgtaattgtgaaatatggctttattatgttcataggcgaatggaaatttgtataaattggaggaaatgttcataatttcgtttctcaagctcagcgtcttgcttaacaagtaataggctattagacttgtcagaaatcaccaaccggattgttctttccaccatggcatgctgacggtcagcttctttttttcttttcaagctagaaagctgtttatgagcaggaattataagattaatagaatggtgtatgcatatagtatatgatttccattcccttttatatgttggcaaactaacttttatttttatatctgattacagaacatggtactgtgtatatcctgttttatactttatgttggataaattgttttagctgttggttactgttcttttgtttatgggcaatactttgtttctgcaggttccctaagtcaactttttggttttttgattgttgaggatggtgctggttttagccatgggggatttgcacataccccacagggcacctgatcttcctgcaaagttcaaatccatgcttgtccccggcaagatccagcacattatttgtactggaaatttgtgtattaaagtatgtccagcttattgaaataactatttctgattcagttttgactgttgccctgccgcattggaatgtaatcagttgtctctactttatagttttcaacttatattttatgaaagcacaagggacaggggtatgaaggtccaatttttttaacttgtcttttgtcttttgacaatgaaatgtttgtcttttaaaaaaatctcgtagttgtaagatttgagttcattcagaaaggttatctctcattacaatgtgtgtactagaacatttagctgtaggacacatcagattttattttgtcacacccaccttgtctgtgttatgtcctgtgtcttcgtcattgtccatgcttcttagaaagaaaattggactattgaaaattttgtaaaactgggtaatctcgggcatgtgcatggaaggtttgtaatcctgtggccagtggtgaagccatgttaaagcctggtgggatgctccttaatttttgtgtagcatagggcaaattgaaagatgttcattgtctcccccaccccgttttcttgttgattgatgaaacatcatatttttttttttctgtaacggtgtaaccaaaaacattttcttattcatataaaattggttttcaagtccatttatatgagggaaaccatgttatttatgacaacagaatgggggtttaataatgatttatgttgttttactattttgccattggtatcatgggtactgtcacattcttgtagcataacttctgttcatgcattacttacccccttagtattatccatctgcatctactaaaaataattcagtacatttgttacggttctattttttatatgctatttattttattcacattaacttgcatgatatggaattagatatgtttttagtggttgaatgcataagctaattacctcatttatcttcaggaaattcatgactacttaaagactctttgtccagacttgcatataactcgtggagagtatgatgaagagacgaaatatccagagaccaaaacactaaccattggccaatttaagctgggactatgccatggccatcaggtctgattttgactctgatattatttgccctttattttttcttaaatggacctaagaaaattgggagcatggatggatcataaggaaattacctttgatatactagtacaaaaatgaacttctaaaggtcaatgactaaggacttattcgggattaagtcaaaggttttaaaattccaattacaacccacaaaaaggttgatttatttttcacccaatcaaaatttctgtcacaagcttgcaatccaagtgccaagcatggcaaatggaaaccaccattgaccctgtactggcaccactcaaagttaatcactttccaatatgctccctcattccagaccccatctagatattattttcttggcagttgataagtgctgcactctgggttttctgatcaaaggtctatgattttaggcaagtataaaaaagtgtttggataggagtagctagtcattcctgtatgttactttgggccttgctacagctaacagctttaatctgagctaaatgatttacttcattctgctactttaggttgcgcttgtgtaggtttatttattctctttcttatcttggttgatggtgcttaacagatgcaatttacatctgttttatttttttgttgcagctgcaactttttccattcaaccatattcctcctgtgattggatttttatgaaactgttattagttatgtttagtagaaacttaaaccgcgccgtattatgtatttttatatgataattatgagtgcttaatggttgtgaaggttattccatggggagacctagactcactggcaatgctacagaggcagcttgatgtagacatccttgtcacaggtcacacccatcaatttacagcttacaaacacgagggaggtgtggttataaatccaggttctgcaacaggtgcctacagcagcatcacttatgacgtgaacccaagttttgtccttatggacatcgacggtctgcgagttgtggtttatgtatacgaacttattgatggagaggttaaggttgacaagattgattttaagaaaacatccacaagcaactctgttcattaaacactaggattttggtcctactctcttttctctttccctttcttatttggctgtttagttttctttttcctccttcaaacttttcaagggtgtattgattttagttgtattttgctttgtatgtacacttgtattgggccatatcataggattttaggatttggtaaatttgtgatctgcgccaaacgtaacgactgattgatcagcaatggctgtgtgtattattactccttttaccagttgcccagagatgatatgcagcaaaaagaaaattttattgtaaaaaggtaggaattaagttgggaattgatcactaaaatttggagagggatacaagtgtatatattgtgtttgtgcatgtcaaagtaattataaaagaaatagaagcaaaagaaacaagaaataaataaaaaatggagaagaaaaaatattataatatagtagttatggttttgagaaaaattcataagaaaaattgtcaaagtattgttaggaaattaaggattcacaaaagaaagcattaaataaaaatatatttttattcaaatttctcctacaattaacaagtatattttttaatatgaaataagctaattagtcatacatttaatattacatttttcattaaatgtgtttagtttttttctcttaacacaaatgcttaagacattatactcattatggtttgaaaaatgaaattgcgtgaccgatatctataaaaaagtatctaatgtttcttattaaaaatatataaaaaaaaattaattgacttaattatatttttgtttctataatttattaaagaaaaatgttagcaacatattctcttttaatactctccaatctttaattcattaaaatttattaaaaataacattctttaaggcttgacaatctatttaatgcagacatcttttatgattttgtggtttccaacgaaatttaaaaagatctatattaattttcaagatattattaaaaaggttattttaatttcaattaaaatacaacatatatttgaagatattattaaaaaatatttttatttaaatttttatgaccaaattaaaaaatactttaaagaattaaaactaaaatttagattagaaaaactaaaattcactaggaataagaatactgcttaatggaacgccattgccttaactaaattttaagaaagaaagaatacattgcatacagttatactttggtttgcgttgtggtaaagtcaatggatcctcaggtttggcacaaagttgcagcgatttcaggtacaatccctttgttatcatgccttcactctttccatttcatcataatccatacccttttcttcagaaactataactgaaactgaaactgaaacattacaggagtggcagcacttggattgggaacctatggtgcccacgtcttccagccccaaaaccctgcttacaaagatgtctctttctttctaccctttcctttttcccatttcattttcatttctattgcatcatgaagcttgttttaattggaatctgtttgtgaaggtttggaacacagcttcgctttaccatttggttcacacagccgccttagttgccgccccaattacaaaacacctcaatgttgtaagttcccatttcccaattttcctactttctcttccctttttgcttgcccctttgaaaaaaaaaatgctattttgctattatatggtcattgtagtgtagagtgtttgtgaactgaaaacatctatttgttttttgattcatcaagttatcattttttattttttttgcagtttggaggccttctaacagccggtatcttggctttctctgggacgtaagtgctatctctaccgttgctgtttaaatgactatgtttctattgtaccatggaattctcttccaactatttgtgatgcttattttggaactagagtaattttttatttatatatttgggggactatttttttaacggcggggggtgaaaaattgtagacgggtatagtgatagtgttcccataagttttctcaagcttaactaggtcaagttgagatacatctgttcaggagtcaggacattgtggaattttatgtttaagccaccaaggtttaaaaggccgagtcattgccacattgatgttgaagatgaatagtttatttcattgtcttggttgcacaataaaagttaggtagggtatcacatatattgtctgaagtattaggtttggactgttggtccaagggatccttggcaaagtgattagaagtgagacattgatttcaacatgggaagggaaccatagttatcaatagcggtcgtagcggtcgggatcacggcagagcgggcatgcaccgctacaaggggtagagtagcggtgcgttttaaggttgcggatgttgcggccacgacggaggggaagcggagcgcccgcgatcgcggtgacgcgaccgtgattgggagtgcgaccttcgatctgcgctgacgatcctctctgcttcgacctgcgccgacgattctccctgctcaagcggccagctgcttttccttctccggtggccaacggcttttccttctctggcggccttgtctggagtcatctctctcttctctggcggctctttcttcttctctgtcgaggtcgagatttttattctctgtttttgtttctttctttttacgacgaagacgcgccgctcagatcgaagcagctgcatcgcgacaacgacgaggaggtcgaggaggcgaagaaggtgaagctgaagaaccctaaggtgacagtcgcggagccggcggcgaagatcgacgccgctgatttggacgctttcctcattaagagatcgacgccgctggtttgattgaagatgatatgatgcgatcgtttgatgtggagatagtggagtgcatgacagctttcacccacttccattcatacttaaaaaaaaataaaaaagttaaattttttgtttctttttatttttatctttttaattctgtttcttttttcttttttatctttttaattctgtttttttttttaaaccaagtttgatattctctgtttctctcttagttttttatttctgtttttttcttttcttaatatcagattattcattttctttgtttattttgaattttaatttgtgtttgcctattttgaattttaatttctagaactttagtaacgtttgactttagagggttcaatacttactttgtagaattgtttctttgacttttatttacatctacgattctattttatattttgcttaagcgtttttattgttaatgataattagtgcatgaatttttagttatatttttctttttcagtttatatatttatattatattttttttaatacatatataaaaacgttagaatagcggtcatcccgctatccgctatctcaattttgagggcggccgctctgctccgctatccgggattgataactatgaaggaactactgcataattttgtcctcagaactgaagggaaaactaagttatttatgttaatgatggaatcatgtataattgcttttactaaaccaaagtctgggtccaaactctataaaaatcaaatcactaacttcagagtcagagatgccaatcaagggatggttaacccggtgcttaagaagacgagcagggcaccagttatcttcagagttatgcccatttatgtcatatcatatggttgacacttgacaatgctgtgggatgtgaccgtgtttattattacagggacttacaaccctataatacctcaacaaagataggttgtctacttaggtacaacggtgatgtgagtgtgtactaagattctttaggcgtgtttttttagtggggaaaaggaaatagaaaaactagcaatttgagtttttgactacccaaactgaagaatgaagctgcttgcaaacaggtctaggagatttcaatggtccctatttgtgattggtgagtcccagtcatcccatgaaatacacagatcagagtgagaattatttgtagatttttggaaaatactaacatatttatttgtgatctgactttcattatcttcgtgaaacaaaggagtgcaaagttctagaatttacatcccattgtttgaagcagttatgcattatccaatattagtgtttgtttacttgacttgatgatgagcaggttggatggtttttgacttgttcattcttgagaagaagaatattttattctttgaacctctgtagtaaaccaaaaacatacatattttgtgtcagattttgaagtatcttatgtcagatggttctgcaattcacttagaatgtggtctgatgccattttcagctgttgcatatagaatacacttataaattagactagcctataacaatattgtcttgctgcatgctgattttttgtaggaaatattggtaaaaattagaatgatcattaagctgtattcattatgatattgaagtaaatgttgaatttttaggtgttatactgtcgcatttcttgaagacagaaaatattcaaccatggcaccatttggcggctttgcatttatagctgcttggggtagcttgcttttctgatgacatcggctttgcatttgttactaagtaattacactatcactgaatcaacagttgcccagcccatattatacttcatattttgtaaatcttttaccatttgtcttgccaatggtttatgatcatgaaatatatgtatctaccgatgatgctaacagattgaagatattctgttgattgttgaagctgattatgtgtagccccatccttagccgaagtagtagtaataataataataataataataaaacaactacttatataactttttgctataaagcataatattccatgtgattgatcataagactaaaatgaatttagcatttttcagttgtgactttggctcctctttggtgctggatacatatgagcaccagctttggccaagaggaaataaattgtacaaattaaatattagtttgaaaccaatgattaagcacaaatgattaatgtgttaaagttaagattaaatcgttcggataatatcttagtttaattcttgtcagaaacaattcttggaaagagtttacttacttttcagttgaactctggattagttagtgtcctcttttttctgatgaaccttagggttaaaatataaaagaaatagtttgatatatggtgtggttttgaaatgcaaatttaaaaaaatataaaaaaaaatctcctcctaaattctacagtaatttttttttttttttgtgaattgaattgtatttgttcttaacgctctcttgtgaatgactctcttcagtatttacaattattgaatagggttagattgtatgcatctgtgtttgtaatttcttaaacttaatgcttattactaattttgtgcgcctaaggaattatttttcattattaagaataaaggtttacttgccaagaaattaaggataagttacattagagtattggatgttaatcacaagaagagaactaggtgagaaagaaattactttaggggaaaactaaggatattctaatacctacctattttcttctatttttttatcagcaaaacataatttattaaagaggtgaaaagaatacaagatgtatccactcacccaacctatcttcttctattgaattttctcataattgtttatttattgtgtcttttttttaatctagaagaaacctaaaattaatcgatcctctcataatttctgaattgaaagagtatgagttgttaaactacaatatttgtgaagacgatactcttacacagctagtagatttgccgtctcttcaaaaaactacttaaataattgttatcagattcaaactttaatgctttagtatctagcaagtatagctaaataaaaacatttagacacatttatttatattatttatagaattcaatctaatcccgagcattctaaggaaggtatcaactgagaattcaaagtaacaggacaagagattatcttcaattcaatccagtttaatagaattagttgataacttccttaatgacatacataaccaccgtttaccttgttacctatatattccttcatctcactataatatagttcattttagaaatatcgagacttattttcatttatatatgcttacatcaacatacagacgcgtacaaccatataacaaagttataaactaaaagaataataataatttaagaaatattttaacaagaaattcagatatagaatatgaaccgtcgtccatcaacacatttgaccttatcaaatggtccgagtttgtttctgttcatcacctaacaccctcttgaaaaaaatttgaagctttgcttagtgtcttcttcaggcgaagaagactaagtgcacattacagaatcctcctaaacaacagttgataaatccacgccaaagaggagcatgcatcttcttctttttgctataacttgtcagcaaagttgcaaagtattattgtttagtttgtgaacgtgaaagcttcaacatgttaggtggagaatcctcctcaaattctccgaatgcgtcttcgcgattgacctaccatgttttcttgagttttagaacagaaggcacccatttagattttgctaacaccttatgtacttcgttgcagcgaaagggaatctcaactttcagatatgataaacaagtggagagaggatatgtgattttggaaaaactacataaagtaattgagcagtgcctcgttgtcattgttcttctctccgagaactatgcttcttccacttggtgtttggatgaactccacaagattcttgaatcgaagagggagctggggacaccagtttttcctctcttttatgatgtcgttccttccgatgttcgacaccagaaaaataaattcgctgaggctttcgaagaacatgcaacaagacatgaagaagacaaagtgaaggtgcaaaaatggagagaatccttgcatgaagttgctggtttttctggctgggagtccaagaattggtaagttttgcttgtgttattttaactgcatgtataagtaggtaaatatgtttttagttctctaaaatatgtgaaatatgaaattgatccctctaaaaaaaaaattcccatttcagtccctctaattttaacgtgtatcacaactttttttttgttgttaaaattgttatatgaatgccttagacaaaattgttcaatcttatatggcacgtcagcagattcgttaatactgtatgaacactaacatattaaaattttaaaggaactgaaatgggataaaaaaatttaaagggatcaactatttatcattaacctaatagttatatatatcatacttccatctatcattaacctaacaacattgtttgaatgaaaatccatgcttcaatttaacaagcaagtactgaatgtatattggttttagagagctcaacatataaaaattagcgaagagctttgttatattttattgctagtgacacttgaattataataaaattatacattttcattaataggaaaaaagaagagctcattgaagaaattattgaatcggtatggacaaaactacgtcctaaactgccatcatacgatgagggactggttggaattgattcaagagttgagaaaatgatttcacttttgaaactagaattgaaagacgaagtttgctttattggaatatggggcatgggtggtatcggaaagacgactctagcgagagttgtatttaggaaaatacgtaacaaatttgatattagttgcttccttgaaaacgtgacggagatttctcataatagtgatggcatgcttagcttacaaggaaaacttctttctcacatgaaaatgaaagacttgaaaatacaaaatttggacgaaggaaaaaacatcataggaggtatcttattcaacaacaaagttctcctggtccttgatgatgttaatgacataaggcaactagagaatttgggtgtgaatgatcaaaagtggttaggccctggaagcaggattataataataacaagagacatggaagtactaagatcacatggaacagttgaaagttacaaaattgatctcttaaattctgatgaatcccttcagctcttcagtcagaaagcatttaaaagagatcaaccattagaacatctattgcagttgtcaaaagtggctgtccaacaagctggaggccttcctctggccattgagatgatgggttcatccttctgtgggagaagtgaatctcaatggaaagaatttttggatgtgaaagaatacacaaataaagatgttgtgatggacaaacttaaaataagctatgatgggttaccgccaaattataagattttatttcttgatattgcatgtttcttcaatgggtgggtaaaagagcatgtaagacaaattctaactatttgtggccgttatccagcaaatggaattgaagttctaattgataaatcactagcaacttatgatggatcacgtttatggatgcatgatttgcttcaagaaatgggaagaaaaattgttgttgaagaatgtcctatagatgctggcaaacgcagtaggttgtggtcaccccaagacactgatcaagcactgaaaagaaataaggtaattttagttgattttatctcatacaaaagttcaatgaatttatatctttactccttatcatagttaacagaattgaacacactacgttgatctttcatatgtcatgttgagtttggataatctttattaaatccttgctgaacttgaggtttataatgagcttgaaatgtaaagaacctcccttcagtccaaacttttgtaaaccaaaaacaatccaaatcatatatatgccttgagagttaagattgattatcttcagcattgtttgccaggaaaatgaattgattcagggtatagttttgcaatcatccactcaaccatacagtgcaaattgggatcccgaagccttctcaaagatgtacaatcttaaattccttgtaattaattatcacaacatacaatttcctcgtggcatcaaatgtctttgcagttcaatgaaatttcttcagtggacggggtgtactttgaaagctttgccacttggtgtgaagctagaggaacttgtagagttgaaaatgcgttacagcaaaataaaaaaaatctggagtgaatctcaagtaagtagctcaggaaaaatatcaatttaataatagcacaatatcttctaaagctaatcattctcaaatttttgttctgattgatcagcatttcgcaaagttgaagttcattgatctgagccattccgaatatttaatagaaagtcctatagtttctggagttccatgtcttgaaattttgcttcttgaaggttgtataaaccttgttgaggttcaccagtctgttggacagcacaagaaacttgttctattgaacttgaaaggctgcataaatcttcaaacccttccaacaaaatttgaaatggattctttggaggaattgattctttctggctgctcaaaagttaaaaagctccccaacttaggaaaaaatatgcaacatttatcactgcttaatttggagaaatgcaaaaatcttctttgcctaccaaagtctatttggaatctgaaatctcttaggaagctcagtatttgcggttgctcaaaattttctaccttgcccaacatcatgaatgaaaatgggtctttggaggaacttgatgtgagtgggactcccataagagaaattacttcgtccaaagtttgtttagaaaatcttaaagagctctcttttggtggaaggaacgaactagcatccaactcatcatggaacttacatcaaaggatttcaatgcgtaggaggcaacaagtcccgaaggagttgatcttgcctactctctcccacttaacaagcttgaagttcttgaatttaagttattgtgaccttaatgatgaatcaattccagatagtcttggatccttattatctttgttgggcttaaatctaagtgggaacaattttgttagtccacctactcgttgcattagtaatcttcatacccttcagagtttgaccttaattgattgcccaaggcttgagtctttgcctatgcttccaccaaatgttcaatgcttgggtacaactaatagtactcaaatgaaacccttgaattcagatgcatatatgctgtggaagatctatgagttacatatgaatcagacatactttttatatactcattctctccctactctgccacttcgccacccaaattatttccataaagtgtgtgtctaccaaatggaagatagaccacattttttgttcatcattccagggaaagagattcagaaatggaatgaagagttctttctaattgatccatcacatcatccatataacaggctgggttctgattcagttgcatcaataatagtggatgttcctaactacttagtgtctagtggatggttaggaattgcaatatgcctagcattagaacctccaaatatgcagcactcttctccatcgcatgtgagtccacatcctgtgggaaatgaggaaacgtgcatatattattgggcatgtaaagttcctcagggtgaacctgacttgactttccccataggacctaaatttagccacttagtttatgaatgcaacgaagagaaatgccaacttcaattgatattttatgtggagaatcattctaagccaagaataaggaagtgtgctagcgttatgagattttgccaagaataaggaagtgtgttaccaattccccttttaattactatttaaaatatataacattctgatcaatagattaaaattttcagttagtaactttcttgtatcaccactgtttatcaattcccattttaatatataaaatatagcgcatgatatataacaccaccactttatacccaatcacctctttggtcggtcactgcatacaatataatttagtatggtttattcccgtacaattaatttagtataattaagtctccttttgctagtaacttaagaattcagcatatacaagtcatagacatgataaacttaagaaatcataataatgcaataaacaagatcacaagaaagtgagatatatggagtttcaaccatccaacagtattcaacctgcatcaatggtctgaattacactacttgttcctatcatgacctatccatttatttaaaaattcttcctcggttgttatctacaaactctccagctagtgttttttgctcggagagaccaagggaaggtttcagaattatattattcaaagaactccacgaaccaaattaaacaatttgttgtatccaccaaagaaggatattcatcttctttgttcacaaaaacatgatatgagctatgttgctttgatggttaaacatcaattgaactattctttccgaaggcgcatgtgcatgtgcatgacaaagcttcaatgttacgtggagaatcttcctcaaactcttcaagatggacataccatgttttcttgagtttaagaggagaagacacccgtttagattttacagatcacttgtatgctgcgttggtgcgaaagggaatcataacttcccgagatgacaaacaactcgagaaaggagatgagatttctcaagaactccctaaagcaattaaggagtccctcggtgccatagtcatgctctctgagaactatatatgcttcttcctcttggtgtttggatgagctcaacaaaattcttgaatcaaatagagttcttggattgaagtttttccagtcttctatggggttagtcctcatgacgttcgacacaagacaacaaagagtttggatgaggcttttagtaaacatgaaagaagatatgggaaagacactgaaaaggtgtaaaaatggagagattccttgaaggaagctggccaaattcctggctgggagtccaaaaattatcagtaagttttgtccgcatcaatttttcatttggatagtgtaaaattgcagtctcttcaaaaaaaaaaaaaatgctagccaattaagtcatattattttaaaattcagcaaatttcatctcttattagtttacattaaaatataattttcaatgaaccaaatgtatctttagtaaaatttctattcgtacttgtctcactcacacccttaatagatatctattgttggttttagttaaacatacatgtgaaaactaataagcttttcttccatttttattaatgtttaaagtgtgacatgattatatttttctcaaccacaggcatcaaacagagctcattgaaaatattgttgaatcagtatggacaaaacttcgtcctaaaatgccatctttcaatgatgggctaattggaattggctcaagagttaagaaaatggattcaattattctaagcatagaatcgcaggacgttcgctttatcggaatatggggcatgggtgggagttgtcctccagaaaatcaaggatcagtttgatattagctgcttccttgacaacattagagagatttctaaagaaagcaatggcatgcttcgcttgcaaacgaaacttctctttcataattggcaataaaaggcttagaaattagcgatttggacgaaggaaagaacacaataataaaccttttagccgagaagaaagttctacttgtccttgatgatgttgatgacactagccaaactaaagagtttgactgagaggctagagtggtttggtcgtgggagcagagttataatcacaacaagggacacacaagtactaatatcacatggagtagttgaaaattacaaaattgtgttcttaaattcagatgaatcccttcaactcttgagtcagaaagccttcaaaggagatgaacctcgagagcactatttggagttgtcaaaagttgtagccaaatatgctggaggccttcctttggtcttggagattttaggttcatttctttgtggaagaagtgaatcccaatggagagaagttgtggatatgataaaagaagtccctgccagtcatattgttaaatatgaaatcgcttagaataagctactatgggttatcgtgacgtcagaaaactttgtttcttgatattgcatgcttctttaaagggagggtaaaagagctcttgctctagaaatttgtgaccgttatccagcagttggaattgaatttctagttgaaaaattattggcaacatatgatggctttacaatagggatgcatgatttgcttcaagaaacagcaagggaaattgttaaaaatgttgaataagtttggaaacatactggaagctgctgataattttttttttatatgcaattcttatttatgcttttgtctaggatgggacattaaattattctttatccatgcacttgcatggaactctacaaaaaaaacgggggttttgtccacagaaactgcaacttgaacaatcccatgatccccaaccaaacatatataagtgctacttactagtttgtaacatttatatatatactgtacacacatgcagtttgccaattgctaacattttggactgtcaaattaatatgtagattgtgataatgcataatggcatgggtttggatacgccttctgggaagctagagacacttgtcaattttcatggtatcagtctttaaagagagatatgttcatagatctgttgctgatcttgcttcactcgagtagtacctttcacctcgtggacatagtggcacaaactattatagccagcttcccttacgttttgttcactgtagttttgcatgcgttgcttatttttttagttatgccataagaaacctttcaaagaaagttctacttcttggctactttgttgttgttttggttgaaggatcctcctatgttttccctgaatcttatgtatataaccttctcctttcgccgaacataaatataaatagccaattaagcagcatatattatatagtatagttccaatatagatgttagatatagtcaaattgcgtatctcccattgtacagtaattttgcttttaaagatcctagaattaaatccttattatcctgtgatactgggagtcaaatacttagtaataggtcaaaagttattaaccaggtataaacctgtttacttaaatccatgatcaaatatcacagttcagtgtgttgggttataaaattaattttgaagtgttataatttatatttggatatttttataggaaaagcaaattgatagaaaaacttactgtaagaaaatttatccaatacaaaaactacttaaaaatatgtggaagtttggaatgtggtgcattggcgtcaactcaattattttttttcaaattcacagtaaagcaagtcttagttacttctaatttttcaattatctaccgcaactttggaagccggaatcaattcagctttgtatccaaacacatgcgccactttaaattagaatcaataatcaatccagaactaattctttaacgtcaaactaatattgtgacaatctatttaaaatcatgttgactaatctttcaaaataattttaaagaattcaagatgaaactaaacacactctcaatatgcacacccaacggatggaacagattgtgttgtgtgttctctatcatcctcttttctatggtggggtatctttctgacggacgggttggcttagtatgaccagtgtctgactttctgttggtattatcaaattggtgctgtttttgccactcagcacaaaagtagtcaatctagctacttggtgatttctctgtcatgtgatttttattttatttcagactaattagtgagtgtgttttgttgatttgtttatttttacttggcaacaagaattgggttgattatctgcttcatagttggtaattctatatcttttcattcacaatcatgagcaagagaactgaattaactgcaatgcatgaggcaattcaaatactagtgctataaactacttataaagatctcatctaatttttcagaagctgacatgtataaactaattttaattcattaaaaataccgattcatttcctataagtgttataaaaaaatttactgtagtttcagcccgctgttgtgtgcatatgaaaatatgatgtgatgcgtcaatcggtgttggttcttgagttctttgttgttgctgggctggctataaaaagggtgaagaaataaggtctaaaatgtaagattaataaaaattgtattattgatagtaatcataattaaaatgaaaaggtcaaaatacaaaaaatattctagggattaattaaaatgtaaaatagcacatgcatggatgcaccgaattgaagagaccaagcacatagtagacaaaatgtcatatgaccaatgcccgaaatatcatactacgacagtgacagaatttgaaaccacaagatgacatccaagagttgttgctgtcaaagtaatcatacgatcttcaatatcatcaatgtatagttcccaatatgatctcttttatatatatatatgctctctaattggacttgcagcaagaaactgtggcacaagatagtgcccataaatgaatgatttggaaattggaatcactgtgagaaacaacatggcatgtgacttaattagaggtatgagaatttgggtttgcaggaggagagagaaaccgacttctgtaactgagctcgtggttcaagcttcaagaatagatagcccaacacccaccaggtggcgcaccacctactctatttctccactttcaatggaacgtggatttttcttcagtttttttttacactctaattgagtcgtgttgttgataaaaaactgttaaactgggatgttggaactccttttgttttgatccattcaaaatcttttttttttttttttaagaatcacacaatatatttctattgtgataccatatcctccctttgttttttttaaaaaaaaaacattttttctgaataatcatacatttcatgggaataatcatatttgaatttattatgatcatgaaataattatcatgtctgagagtcaatattactcactaacctttggtttagttgagatgaaatcggtgaaaaaagagagaaaaaatcattatttaatatggatgtcagaactcacacatttattacactacttcaattattttattttattttaattttctttctttgtttcattctacacaaccaaaccatatatacctgtggcagtaaaaatggaacacgataataaataaaaggagtaaatgattaagtccgaatccttaaattggcaggagtatgttgcttgtccgatggtattgactattgcgaataagataaagcttttaacaattattaatatagaaatacaaaatcaattaaagaaataaaataatttaagtttcttatataaattaaaattaatttacattttaactatttataagcacaaagcacttacatagttataaattaataaaatcctatattaaaagtcaaaaaatattttatttagagacctctataaattaaaaggttgactattttttagagcaaaagttaatctaaattgacagcatcttagaagagttatattaattatattaatattcttacaccacttttgataaccttgttgatgtatctctttttattatatcatatcattcaacatatttcacttatctcttttctccttattgtctttctctgatcattatagaatcttttgcatagttttgatgtaaaaagataatttcttaattgagattaataaaagactgtgtcaatgggattgcgtcatcatgttgaagacatgtatatatatacaaatgtaaataatcatccaatgaaggcttttaccacagaccagaacgtgaggatctacctaaaagaatttgtattaaaaagttagcacttttcagtttttttttttcctttttacataaactagcatacatgcacacatgacataatgtcacaagttaactgtatgaatctttattcacatgggttcaagttccctggcccagccaaggacaaattgggaaaactatttatatggaagaaggtgcactttttaggttgtcaaattgatagtatgatgcagaaaatgttacgtataatttatggccaacttttggacgtctctgtttctaaaaattgttgccattagccactgcagcatgccgaagatgtgaatttcagtttaattctttcctcatctgataaataataacaaactggcttcttaattagtacaataaactgtatttttaatactttaagaaatggtaaaactgttaataatgtgtttagatttccctttaaaacaattaaagtcataattcgagtgaaaacttaaacaaagcaaaacaaaacttatgttcaaatcatgatatatggaaacattacacataccaagagtgtgtttgattgcatgtcaggagagaaaatatccgttattgaatgtgaaaatcaaaagcaacagacaccattcactcactaaatactaattcgccaattgcatcatggggattgaactgtgttaagatattctacatgttcaaatgaaagagggaattgattcaatcgagattcatgataactttttagcaggatttgttgacgatgaactctgcaaatcattaacaagtaaacaggaattatttactataacctttcgctgttactttatctgctggaagctggctttttcttttctaacggccactttgaaagcttctcttcccatagacacttttgattttttttttttaaaaaaaaaaatcacagcaaaaatttaatttctcatttgtaaattatagaacactgtctcaagaggattatgtcatcatgttgaagactattaaaatgtaaataatcatctcatgaaggctttttttaagagactatgtgtatttttttagcaaaattaattttgtttcagttgataaagcaataaaaaaaatccttctaaatatttaatattaacaacatactgacatgaatttaaaattactagttagatattattatgggagaagttgattgttgaaatgataatttatttaacagaaatacaatatatccattttttttttcaaattggaatattttaaagagatatattgaattatatgggtattattaaaaccatttcatttcaatgaatctaggcgatgagaaagatctatatctaatatgtaatgtaacacagttcccattaaaaaaatgtatgaaaaagttagcacatttttcacataaaatagcatagatttatacataacataatgtcacaagttaactatgaatctttactcacatggattcaagtacccgtacccagccgagaacataatgggaaaaatcttatataaaagaaagtgcacttttggttgtcaaattgctagtatgatgcagagaatgtcatgtatgatttttggccaacttttggacgtctttgtttataaattttgttttgtcataagctactgcaggaggccgaagatgaggatttcagttttgttcttccctcacctaataaataataacaaactggtttcttgtttggtacaataaactattttaatactctttctcctcatttttacacgactcaattaattaacttataatgatgaaggaaattaatttagttagttagtcgtattgattttttcttaaatttatgcattttaaaattttctctaacatttcaatcatacatacttttgtttatttatataaaaaagaatcagagaaaatactttaagaaatgataaaacaattaatgtgtttggattttacttgaaaaacttaaagtcataatttcagtgaaaaaactaaaaacagaaaaacaaacaatattttttgctcaaatcatgatatgtggggcattgcactctccaactcgtcaattgcatccgttgggttgaactgggttcggatattctacatgctcattgtataaaatgaaataggtaattgatgccatcgagattcgtagttactttttagcagtatttgtggaaaatgaactctgcaaatcattaaaattgcaaacaaactattcgctattaattagtctattacctttcactgttaccttatattatgggagttggcttttctttttatggccgttaggcaagtttgaaagcttcccattccattgactttgtctccctagccatttgtacaggcacagcaaccaattattcaattcatgattctttaacctattttttttatttatttataaatgtaaaaaatacgagttttttgacaagaaaataataaagttacataaagctggttagaagtaaataattttgcataaaaaataatatttgtattagaaattattatttgaactaggagattgagagaaattggtgaaacgtaaggataacaatgagtttatttctaatgctgttgtagtgtgaatgtgaatataaacttctatgttgggtcagagtagacaaatttagtaatatataaatgagaatgattcacaaatttattcttttaatatggataaatttagtaatatataaatgagaatgattcacaaatttattcttttaatatggtgttgattttatttgtgtactacctccttattatatcttttaatgttttaatttttttcaaaatatttgatgttttaaaattttaaaagtctaattaatatatattttttaaatatattcttatttaacatttactattagtaatgtaagtatcaaagatcaatgtattaaaaaagtcattttagtttaaatataataaattttagttttattaaatatttttaatttatgtgtaatagtcttaaatatcaaaagatatgagaataaaatattatttcatttatagtttattgatgaaaatcttccaacttttttatcatgctcctattcccaacaaagacaaagaagtatttaaatgtatcatattattattttcaaattatcttcaccattcttatttattatgtaattattttatgttatttttgtctaatttgtacatatctcttccgaaaaaaacatgttaattatgttattctcgttattcattatagtttctgcctcttcaaccgtaaatagctcaaataaaagaatccaatgacagacaaacttgtataggaaaagcacaaagttttgagtatgtttaaacttaaaaaaaaattaaaataaatatattttatatatgtttttacatttaaaaaacatataagattttattcttaaaataatcagaaaattgattttttaaacagaaataatttagacaaacacactgaaaaacagaaaattatttaaaataaacacttattttaataaataattttaaataaactgaatatcattacagtttttatttattcattaaagcaatacaaaacctttgctaaaagttattaatatcattcaaactaaattaaaacatcattaaaaatataaataacaatttttcaagtgcattctaatgccaactttttacttctcataaccacactataataataaaaattgccccaagtatgacatgaagcaacagtttttttatagaaaaagaacaaagttttcagtatgtttaaattttaaaaaaaaaaattaaaataaatttttttatatgtttttacatttaaaaaaacagataagatttcattcttaaaataataagaaaattgattttttaaaccgaaataatttcgacacactgaaaaatagaaaattatttaaaataaacacttattttaataaataaatttcaataaactgaatatcattacagtttttttatattcatgaaagcaatataaaacctttgctaaaagttactaatatcattcaaactaaattgaaacatcattaaaaatataaataacaatttttcaagtgcattctaatgccaactttttacttctcataaccacactataataataaaaattgccccaagtatgacatgaagcaacagttttttataacacctaaaatatattatagctaagaatcaaatatatgtcgtcacaaatacttaatacattgttaactattatatattacctaagaaaaataaattacccaaggaaaaaaaacagtaatgtgtaattgtaaagtctccatgctattgcttttgagctattcgttatggaaatcatttttgcatgtgatcagcacttagtttttatctcacagaaaccctactcacttcttttcttggatgaaaaaggttgcaagttctgaattaagtcccacggggatgactcacccacccttccaaataaagctaaatatactgaatggtaggtacactaccctataaccatgagctgcaactttacttcacaagcaattagtcaattagaggatactctaggtcacctaaattgagaaaatagtctcaccctaagcgtgatttaataacattagtcaaggacgggattaaattttaataaaggtttagtttttattattcttaaacatagttttttttttatgttttacttcaattaaattttcttccaaagttaattatctcatataatccttctgaacaaaattttaataagacgcccatgtgatgcagtggaagaaaacggtacttcaaatataacgaaacctgaagaacaatgatcactttagaaatcacaaaagataaagtctactgcaaagtataaaaaatcttacatacaatttactttagtgctcaaagttaaattaatgtagttactagctaccccattaccagttcccaccaactggaagaaaagtcaacattattaactaacataatccataacccctaaaaaatcttcaaactaatataaaccaacaagtaatttatcttctcttcctagtctcacttccagacaacttcccattgcatactttacacacagcaaaatcagccagatgcatattctcatgcgggaatatctctgccctcttcagcttttagtatccagtaggaaactcgcagctaccataccctgcaaaataacaactttggttaattatgctcacatccacatatctataatttcaactaaaaaaatcaataaagtacaattattacaaattttcattaggttggtgtccatttcccttgtccctttgggaatagggttttcgccaaaattgtgctaaacaaaaaagcattttttttttcatagaccaaataacacaacactgtagcaccgtaattagaatggacccctatagtacactctacccaataaagttacgccacgtcgttatcataaaagattcccccttgtttttatgtccactgacctatcgtacaccactcttctaaccccgctcacgttagcagcgcaacataacactattctaaactacacacaatcaggagataaaaaagtaaaagatttaaatatgatttttcatatatgtaatattcttcttttctaatttattgcctaaaaatcatttttatttattttacaatgtaacaatttttaaacttttatttttagtatttgctgatagttagtttacgtgacacacttgccacatgttcacttaacaaataatttggcattctgttaatttatttagtaataaactgaaaaagaaaaattcatgtatcaaaacatatttaaggcaaaataaaaatataaggggtttatagaatactcactaggttcctgcgtgaccacgtacgacgtacccccgaaatagcagctaccaccctttcgcgactgcttctggtaataactgttgaacgcgaacgaagcgtgggccacaagcgtgttaggatcgtaacacgtggcaccgcgctgaatagtaccgcaatcagcacctccctcgccgcaagcgaaatctagagccgcctgcaacttaaccttatccgcgtccgggttcgccacgcaccatgtgttcccagtggtactcttggaaaccccgccgctcacaacgggcgccggcgtctccttctgtccgccgcctttcaccggcgccgacggacggtcgtggtagtccttgagctcctccaccgttaacggaacattgtaaaccctcctctcgtccgggtaaaaaagcccaaagtttctctcggaagtgggcccgggcttctggttctcattaaaaagcgcgaagagataaacggtgagatccgctttgggcctgaggggggtcccaccaccggtcaagatcttacgaacaagattcccgttgtacgctgcagcgttctctaggctggcacctacctcattactatcccctttagaaggccaacctgtttcagtaaccacgatcttaacgtcgtcgaatttcaaagcacttagcgcagagaaaacggcgtcgatttgggcgtcaaataggttataatatctcaacccgttacccggatccaccactccggggttatcacggaacagcgcgtagtccaaagagatgacatcagcgtttgactcatacgcgaaaaacgggtacacgttaaccattaggtatgacccagtttcgagtagaaagtccagcatgggcttgaaaacgggttccacgagttcgggtcggaatgacccggcggaggaagggtaagagtttgcaagcgcggagagtgcaatgggagaggaaaccttaatgtccttgtcgaggttgtgcttggtgagggctttttggatgttcttcattgcgggtacgaggaacttggtggtgttgtgtgggtccacgaaaacctcgttgccgaccgcaatggattcgatttgcgtgtgagggtagaacgcggctacgttcctttcgacccatgaggatgcaaaggagggagctttggcggctgcgaaaagttgctggttcggaagatcaaccgtcactttgattccggatccggatagtgctcggagcactgccgggtcggtgtcgtaaactttgacacgtgtcagtccttgggatttgaggagttgaacgaccttcaccgcggaggggaggttgttcgctatgcgaccgtagttaactccaatggaacctccatctgaaacaaacaaacaaacaatgtaggataaaagggttaactttgttatgcaaaaacaatgtagaataaaagggttgactttattatgcaagaatgaaagaagagaaagagagaaatgaagtggtagaggtaagcattacctgcgagtgcgagggaaaggagaatggtgaggatgatgaagcgatgcattctctgcttctgtggggagaaacagagcgacagagagagagggtttgggtttgttgtgttgttgacgatgtttctgggaatgtggtgtgcagagagtgtttgtttgtgtggagcaagtgggtgacgtgagagagagtggtgtgtgtttgttactatgtatgaagggaagggtgttgagggaaacgaggtggtgggaaagtgggacccaccatccatcactcatggcctgcctcatgctgctgctgatgaagttcaagaactggagggatgcgcgttttgtcccacaaaaaagggccttagatcgggatttcaatgtttttattattaaattcataagaggaatgattattgattagtataaggtgatcataaatatattgatttttaaaataatttaaataataatttattattaaataatagtataaaattgttttatattatatataggtatgaaattctaaatttattttttaaaatgatatgattatggacactttttgtggtgcatgaattatgattttctgtaggattttttcttttaatgaagaaacatccgaaaaaaggccaatttaagaatcagaatgaaaattgactatggcattttattcattgctgtatttaagatctcgacatcacagggaataacgttttgaaggagctgctatcatccgttaatgataaagataaattaaaaaatggtcatactaatttcgtgtacttcaattaccttataataaaagaatacctagctagtttttgaacaaatggtaaaattcaattttacatcattgtcttgtcagatcttctttgccttttttttttttttttttnnnnnnnnnnnnnnnntacaaatggttttgtatcttcgcttttgcacctaaataatccgtaaagataattaatctaatcgaacctttgcggatgagggtcgaatgtgtagcacattgtccttgggacacaaggtctaacttgtttgccagttattttcttggtaacgtatgagtaaagagtaattaatgactccaatggacatcatttatgtcaatccaaaaataccaataaaattttacttcaaaccttacaacatattcctttaacgggtttttcttttcttttttagtaaattacatatttttcatataatatttaagaaaattataagtcatatattttttaaaaattgtacacattttttctaagatttaaggaaattacatgtttctcatgagatttaaaaaattatatacaaatctcttttatttttaaaatctacacaaattctcctaataaatataagttcagatgtattcgaagttaattttgaacaaaatctaacaaatttaaatttttctagttacaaaaaatagataatttttttttgcaacgacgaattccaaacatttttatttttataaggacgaaacatatattttaatttattttaattaaaattgttaacgcatatgacttttaattgtcaaatatttagacgatatttattgaatttgtataggttttaaaaatagaaaaaagatatatatatatatatatatatataattttcttaaattttaggagaggcacatataggttttatataaaggaggaaaaatatgtataattttttaaaattttagagaaaaatatatataattttttttcttttattaaaagcaagatatctcaatagcagaaaatcataaaatgattttttatatgcacgatgagtaaattgaatctcttttagtatacttgaagaaacaagctttttccttcttttatgtaagaaaaaaaggagatcaactttcattcagtgcatctttaaataaaatactacctaagtgtcgaacaagcaaagcccacaacttctcagatgttgtttgcaatctctcatcctcctcaaggttcacttcgttttcttcttattttcttgaaaaatcaagactaaaacttggtgacaatttatcaaaaggctaaatgacaacttcctaatcctaaaggacaaattattaacaaaatcaaggccaaaaaagtgtcaaaaaaaggaaaggataagataagtgtcaaattgtaagataaaattggcacgtatcaatactcaagtcagccttagaggccttgggtcactgatttccttggttcatttcttgggcttgagcttctctagtctcaaaggtccattctttttattcttaccattttctctctttctttggatcggtagaagttgttattacatatggactctaataccatattgggttcaaccctttacctggacaacttatacttcttcctaagcttatactcaagtcagtctcgacctcatattttttgctttctctttttctctgtctgttgcttgggcttgtgattcttgagtctcgaaggcctatgtgtttttttaatatatattttttgggtcgatgcaatgggctactacattatttaggctttgataacaagtaggaattttcgcacagacccaaaattaagttagtgtggactaggttgaattcatatgaaacataagaatgtatcgtccaaaagattcaaaccaattcgactatgtcctctatgcttatatacactaacgtttgtctttatttgctcaatggatccttttaaagttaccatgtttacattgtagaatttaagatatataaaagccaggtcaaagtgtttatcagcacaagaataaatgaaatataaaagtcaagaacaaggcgataaagtgatgttgtcattcagaacacttgtactttagagacatgattaaatcaaacctatttcagtttatgggctgttccattttgattacccaaaaaatgtatccaacaccaccacgcccacaaagagaaacacacaaattatcaaacccgttggtcgtttaaattttagtaataaggaaaaaaagctgagaattgaaaagtgcctaaaaaaatcttgtaatgagcgattgccatgcataaaaaccacaattgtagatcatatttagatgtacgaaaatgacattaactaaaaacaaattaagaaaatgaaaacaaaaaatagtaacagacattggtattttgggctatataggtcgaacacgttgttaagcaatcgtgggcctgtctaatagacctgtttagtacaaataacaacattgtggttggtccatcatttgcaagaaaattaatatgatttattttatacactatataaatttttaatatattatatgtgaatttctaatatattatatgtgaacagtgtgtaaatgaaaataactttcatccaatccgtatgagtcatacgaaaataatatgcagtagatagaaagaagcagcatgtagtaatatgaaaaagtgatattttataaatatgaaaatatatttaaactttgtttgtcttcatcagtagaagtaacattgttgttacaatagatgtactggcagaaataaatttaaaattagtagattcatttgtattatttctcatttcttcatctcttttatcattttttaattattttattcaacaaaacacttttatttttcactttaaatcttactaatttggattcctttttttctatccactgtatttctcttctctctgtcagcctaaaagataaaagaatatctatatactgataaaagataaaactaatattttcaggaaaaaaatataaaattatataattttgtggtattttatgttaatcttgctttcttttttttctctctcctatcattctttcaggaatcaagccttagtgcaacacgtgcatgttgcaccgtttcttactttttgcggtcacaatctcttgccatgtgataaattcgtgtcccctcctactactttttcctggtttcgttccttgccaccgccacacaagtatgaacaaaagtaataatgggttgaaaataactaatcgaaataattaaaaaaatataaaataatattaaaaataataaaattataatttatttaaaaaaataattaaaaaattaaataaatatattgaatataaaaattaaaaattaatattttaaaaatataattttaaataatattttaaaaaactaaaaagttactcagattatattagaaaaattagctaaaaattaattagaaactgaaaaattagttagtagttaaaagttaaaaaattagctaattaaattaattaagtaatataaaatgacagaaaaaataaaatcatgattatttaaagagaataactaaaaaattagatatatatatatatatatatatatatatatattgaggataaaaagaaagaaaatataaaaaatcagaagctagtatattaaaaaatgttacttcaagtaacagtttaaaaaacggtaaaagttagttaaagaaacttttcaattaataaaaagaattaaaaattaactaacatgtcttatcaaatatatggaaagcttcattaaaagttgaaaaatcaacttattaaattataaatgttggataaaattagttgttaaaataattaaaaaatataaattataaaaaataataaaattattatttattaaaaagataaaaaattaaataaatatattgtggataaaaatgaaaaaaatattaaaaaaaattgaaactaaaaactagtttaaatatctgttacccattttccaatataagcagaggcacagtctagactatagccacccctgaacagaaaaacagttgaagatacatgatgtcattctccatcttcaaacttgttttgacattatttcttctctgctttttcttgcaggaacctaccaatgctcttagaaaggcaagtaagctttgcattttattagttccctgattgttttcttgtcaatcttatggagttttgtaactgttcaagttccaactttgagaatttccctgattttatattttgttggattctgttttcagacctacattgtgtacatgggaggacattctcatggtccagaccctttgcctagtgatcttgaaacagccacaaattcccatcatgatttactcgcttcttacttaggaaggtaaaacaaatgttaatttctgttaaatattattaggacgtacgtgttaattaaaaattgataatttaacagtcatgagaaggccaaggaagcaatgatgtactcgtacaataagcacatcaatggctttgctgccctacttgaagaggaagaagcatcacagattgcaagtgagcaaagactattactattaccattaccatgaccatgattttgtactcatcttgaagcctcacaaattgatataatgtaatatatgtttgtattggttcagaaaacccaaatgtagtttctgttttcttgagcaaagaacacaaattgcatacaaccaggtcatgggaatttcttggactggaaaaaaatggaagaattcctgcaaactctgcttggaggaaagcaagatttggagaaaatataatcatcgctaatatcgatacaggtatgcttaatgcttagttaaaaattattagagattataaatttataattgaaatctggtaaataagaaataaatctcacataatttgatgattcagcgttatcaaataatttattttaaaatttatataaaacatattatcaatatttttcttcaatacaacaaaaaaagtaaatatatgtaaatcatttttatatttttatctaatcactaatttactatgaatattaaatttgttgatttttatataattacttaaaaaattataacgatattttttttattaattgacactgtccaataacattctatagaaattaaattaagaatagaaacgcatcttttcaattctctgtttcaatcgtcactatcatttggttttctgttattgtttaagactttcatttgtctttgactatatatatatatatatatatacgtgtgtgtgtgtgtgagtttttatttcttatgaatatatacatgcaaaaaaaattattctttataaatttaataaattttgaaaacaattttgttccatacttgctaacttttttccaaacatctctctatgaagtgaaaataattataaaatttaaattattaaagtaattgcataaatatatataaatttgagaaactatctgtcttaattaaaatttattaaattcattcacactaactttgagctgaaagtttgaattagtgattcattatgatatctattcgatcggactgaatcagggacaattttgggtttttttcaacaaagttgaatatttagcttaatatctctcactaatttaattaagtagcttagatttatacagtgtccccataaatttgtactccaaacatattttcctttttgtaaatacgttagttgcttctaaacaggagtttggcccgaacaccctagtttccgtgacaaaggatatgggcctgtcccttcaaagtggcgtgggaaaggtgtctgtgagatcgacacttataatggtttgtctacaaataaatgtttctgtaacaggtaaattttctttgttatttcaattcgtaaattggggttgaagttgaactaccctataggcacataacaaattacgagccaggcgatattctttttactgaaatatatataaccttaggtaattaaatgtaatttataaaattaatactgaagttagtgtaaagatatataaattaatggatcagatgaggctgcatacattatcattttgtacagagaaaataaaaaattatttattattctatgtgcaatcattgcacaaatgttttgttttatagttaattaaagcttagccaaaggacagatattgaatttgtgatgtagccattaataaataatcctaagcgaaggacaaggacagggaccagaacccgaaacttccctgttcagattgtttcttatggattcgtccatgcggattatagattgtaaattttcttaatttttgtttgggaagtaggaggagaagaaagatatttaatgggaaggaaagggagaaaaatgaaaaaaaaaattttgtttgagagttaacaatatattaagagaggaaaattgagagttaataagatacttttataatttttcttatacttcaaatgttaatacactttatattttacaaataaaacttgattttgaatttggagaagatagtagttttattactttttcttctaaaaatcctcaaatttgtagaataacaattttaatgatttggaggaatttagaggagttttaaaaatcctcaaattcttttcctcaaaaattaaaactctcaaacaaagagatgttactactcaaacatttttcttccctcccttctcctctaaaatctctctcccaaataaagccttagggtagtttgattgtccgagaagttaccatgatttttttttaaaataatatggattccacaactttatattttatttttatttaaatatttttattaattttaattttttttctgtttcacataattaaacttatccttaataacacaaaaaaaaaatacatactttatgttcgataaaatattttaattattttttaattttttataaattaaaaagtttatttaattgtttaataaatatatttttaaaattttttaaatactactttagtttttgaaatgttagtttataatttttttttatcttgaatatatttatcaaattttttaatttctttattaaataaattatgatttattattttttatcattttatatttatcagttattcaacagttaattttactacttacttataatttaataagattaattttgaacttttagttactaacttttaatttttagtttttaattaatttttgaactagttttagtgaatataaccataataaaatttaaattttgcatatattatatttcaattaggttgagctaaggtttttaaaacggtatgattatcctttcaaaagaaaacggtgtgatttatagagatttaatggtgtagtcatgaaagtgttgcagagtaataattagtaaaatattaaaatatttttagttcttataattttttttcatccataaaaaaataaattagcactttctgtcgaatttcggagtcagtcgtagaggatatggcatgcagtaccatttgcagtggtattttgtccttattttatgtgaaaaaaatattaaaataagtcatttttagaatgtagtaattatattgttttcataattagtatgttagatccatgtaaattgtaattactgtaccaaaaaagggatctgtaattatttatgttgaattatcattgaaaagagcctaacacatccggtgaaaatataattatgatgaatattcaggaagttgatcggagcaagaatttttctaaaaaattgggaggccgaagataagaagattgacccaaggctacgcagcggacgtgacttcgtagggcacggtacccacacactgtcaactgctggtggtaattttgttcgcggtgcaaatgttgaaggtaacggcaatggtactgctaagggaggctccccaaaagctcgtgttgtagcctacaaagcatgctggaataatcaggacgtagaagggtgccatgaagcagacatgctacaagcatttgatcatgccatttatgatggtgttgatgtcatctcagcctctgtgggtgcgtctaatccctataaggaagctttgttaacagatgggatttccatagggtcactccatgcagtcgccaaaaacatagtggttgtttgctctgctggaaatgatggaccatcacctttaagtgtcacaaatgttgcaccctggtccttcaccgttgctgctagcacaatcgacagggattttatcagcaacatttctctcaacaacaatcaatccattacggtaagagatctaatctagagattgatttatttcatatttttattatgtcaacttaatttgaccgtacttgtatcagggtgccagtcttaatcgaggcttgtcaccatcatcgccgtcgcaaaagttctattccgtgattaaatctgttgacgctaaacttcctaatgtgtccacggatgatgcgtaagcacagttttattttttgtttcccaagtttgctcaaatatttatatatacttgtcttatacgtttcgtgtgtatatatgtatgtatcttggtgtagccgtctttgcaaagcgggaacacttgatcctagaaaagtaaggggaaagatactaatctgccttcgaggcaataaattaacttcagctaaagaggtccaacagggtcatcttgctggcgctgtctcagtttttgtgctgaatgataagggaagtggaaatttacttctggccgaggatcatattttaccagctgcaagtgtcggtggaaaacaaaccgatcaatatgatattaatgatgacaatagtaaaggcggcagtaagcagtaaagtctatatactaatcccttttaaccgaatatatatatatatatatatatatatatatatatatgcttgctattggattatttttgtaggaaatatttttaagagagaaaaagatgttgagaattatttttatggaatgagttgttactgtagagttcaaaagaatgtattagaagaaaggattagaagttgttgttgattttattgttagtagttacaaatgttaggatttcatgactatttatactagtccataaatatatttaaatttatttaaaaattagagaacctagaatcttctactatagtgacttattttctatcatattctagaatcatcaaatacataagaaatatagaattctctatataattctctagaatattcaagaagtaggcttctctagaatatttatgagagatgtaaataaatgcattaattttaacacttacagcaaagcaagtgaagcacttaaatattaatttatatatatgtttgttgcagggagattttagcttatttgagtgctgcagaaacacatataggagtaaacccagctcctatcatagctggattctcatccagaggtcccagttccgtgcaaccattgatactaaaggtctataatatatacattaattttgttaactacacccagtggcggactcagggggggtcttttgaccgcaagtgcagacataaactaatgtttctttttttctgcattcaaacgagtcattcaaacgggactcccttataaactattgtttcatacttttaggcgtaacatggtttttgaagcctgtacagggtactctcacagcctcactatagcatgtgaaaaaaggcactattgcagtaaaaaaaaaaagtagccaagggtagttgttaaaaaaaaaaaaaaagtagccaagggccactccgctatagcatgtagttgactactatgattaaaaaattgtaattcatgtgatgttagtttgttaaatggtgcctaactgcttatgtgaggttgtggtaaaataatttaatttatgtgagtatgtgaaatttattcttgttgacacttattacttaaaatggtaagttaattttatctattgatagtgaaatattatttaaattttctttaaaaaaaaaaaatcgggggcgctgcccccgaaccgtccaccattaagtgtgcggacataaaaacatttttctggatccgccactgactacacctacatgactagatgattaacttttcattcttacaattaatgattcgttagagatgaatttgtggctaacataattggtttcttttttcagcctgacataacagctcctggtgtgagcataattgctgctttttcacaagccgcgggtccgactaatcttgcaacagatagacgtcgggttcttttcaccgtgcaacagggaacttctatgtcttgtcctcatgttgctggcattgcgggtcttctcaaaacatatcatcctaattggactccagcagctatcaaatctgctattatgactacaggtacgttaatcaccaaagtaatatcaatataaaatcttcatgcacagcaaatcgttggcggcttattaacaactatgcttttttatcaatttcagctacaacactagataataccaatcaacctattcggaatgcatttgataagaaagcaactcccttcgaatacggcgccggacacattcagcctaaccttgcaattcaccctggacttgtttatgatttaagcacaaccgattacttgaacttcctatgtgcttctggttacaaccaagctttactcaagttttttctcaatttgaaatccccttacagttgtcccaagtcttacagaattgaagatttcaactatccttcaattacggtgcatcatcctggctcaaagactattaatgttactcgaacagttacaaatgttgggcctccaagcacgtatgttgtgaatactcactggccgaaggggattaaggttcttgtgcaaccaagttcgttgacttttaagaaaactggagaaaaaaagaagtttcaggttattcttcaggcaattggtgtgcctggtcacaacattcctttatttgggaatttgtcttggacggatggcaagtacagagtaactagtccaatcgtagtgctggacacttagaaattactctcagcattgttatgttatcattgtcattttagtttgtttgccttttgttgttttttaggctgtaatataagcgtgttttctgttcatgttgcattgaagtgctttgtcacaaaaaataaaaggcacaatcaataatatgcagtttaaaagtatagttgtataatgaagaaaagagagggaaaaaaaaaagaatctagatacggttatgtgagccttaaactctaaataatcagtaatatcataggtactagagaatttatgtcatccttcttttattttaattcttttttttttcgtttttgtcttatttttatttattattgaatttatatcccaattaatttatgttaaagatgctcttgatgatattaatattgatgttccctttttaattataatattttatcttttagttttataaattgataattttgattccttggtagattattaataatcatttgtgattaataaagttatgaaattaattaaaaatcattaactaaaactttgataaaagaattattaatcctaatcctttacaacgtagcactcctcctcttttatataaacatctctttcacttccattattgctgcaaatgacttcactggtagtagcaacatatttggataaataatcttttatgaaagtttttttaatgattaatagtttttatttgttataattaatttaataactttattaatcataattattagttaataatcaatcaatgaaatcataatcattaatttataaaactaggagatcaaatgatattatgtttcaagaatgtcctgacccccttcctttatttgctactgatttccagcacatgaaattgaagcactgtccaaaaatgaccatttccttcttaaaccatttatttgatctggagttcacttaactataaacgaaaaaattagaagataaatttcaaaaacaaattaagatatgcaatgaaaaacatgaatattttttttacccacacatctgcttcccaatccgatcacaatggcaagtttaataccatacaaattcttcaaaactggaaatttcttctttgaaattacaagatcaaacaaaactaacgtcgtcacagtagtttctcaatgtattagattcttttatatatctcgcactccacggataagccaataacagattacaactaaatagcaacaacaagccaataacggaagtattgaagaacaataaaatttgaaaaacttcaagaacccatttgttccgttcgttacaaacggaggtccagtaatgaaactgggtcttgatgtatgatcaaggttctctctctctttgaatgctatggaggttgaagcacccagaggaagatgaagatcacagcaaacaacacgacacaagtggtgtgcagtgtgtgcttatgtgaaaggaaaagagagagtcagaatatgtgtgtgtacctttcacctttgatatgaggggctatttatgctttcactaacctgtgtttaaatgaggaaacctttgtcaattcttgatcgtgatctgcaaaagatgagcatatattttagatatttgctgataaaataatctcgaattgtccttgatttggtgcagatttaaggccttattctttccgttaataacttcatcttgactgttttgggcctcatggtcttggcccaatatacgaattccataacggttgcccctcatctcggttatcgagcactctggatgaccgagatgaatattttctctctttcgattccgtagccgaaatactttatttcaaacaagcggcttgatgttaatgtgtatttgtgaccaacatgtttcgttctcggctttggggccgatctcatttctttgtcgtttggccgagatgtcggcctctttctccatttcctgccaatgtgccactttttcgtccgactttgtccgagatatctcgaaaacgctcttgcgaagccgagctcttttcttgattcagtctgagataacgaaacgttttccctgcaaaaggccgacctcctttttcggtttccgaattccaaggcaatgaagtacttttgctggtttttggacatctgaagtgacgcgcctccctagcatttaatgctctgccattaccttgcacgttctaatcatgactacttttgccataagtcccttttgcccctgtctcttgattaactgttcatgattgtcccattaatctagcacgtttcgtcagttatcttttttaattttgatttcgacggttaccacttttttgatttcgtgggcttggcggtttctttcctcactttatagcctataactcatcattttccctattttctaaaacccttggcttatttcttccgctgcttctttctgctcaagctttctccttgcgttcttcattctggtgtttcttgcttcttcttcaaaagctttttatcccagttatttccttttctccttcccttttacttcgtgtttctgcatttctacttcttcttctttcttctttttgtttcattagtacctactccttttaggtattttctgggttttctgtcctattcctttatttcccgtcccttcatcttctttcattatctattcatcttcatccttcgtttttctgaaaaaactccttagcttacaatggtaaaacttaccccagaagaggaggctcaaatcgccgaaagggtcacccctggtgtggcctattggctttttggtaaaccccttagtgaggaggagaaaaacagacgcttccttaggaccccctctggtggttcaaaccctcctagaaaacccagaaaaccacattcctctagagttgttgttcattctggccaggggcccaagcgtaggactaggggttcgcctgaaattccttttggtattcccttacccccaaaacccaaagatcccacccctaacattcgatacgaaacttgtgaaaaatgcatggacgaattcttctattatgccaatgtggggcgttatggagatgccgaggccgttatagatcattgccgacataatcccataccagttcccccatctatgcccgagaaagctgtatcgagattggtcagcccgcccttgcctcactctccccaagagtcggtcgtccccttgctagtccttcctgaagctgtttcaggtattattgctgactatcacctttttttctttgcctttttgtcttaggttatcatggaagtccccttcgtggaaattgttgaagaatcccggtcaagtgattctcacgtcgacaacccctctcccgacttaatagcccgttttccttgggcgtcttatgaggttcttaatacctcttcttccataagcctggagggcatatccgccctccccgtgggaaaccaagaaggcttttccatccgccaccccggccatcatgtgccgatctgctcaaatgccgagcgcggtgagcctagcttcttctttttctgtgccgatgttgtcacccgtttgggtatccattttcctttgtccgagttcgaaatgaacctgttaaaacatctatctttggccccttcacaacttcaccccaatggttgggccttcatcaagtcttttgaagatctctgtattaacttaggcgtaccatgttcagttctcgtttttatgtattacttttcggttcagaccagcagttcgggtcgagaactttccagttacaaagggtggacttccttgcggagtcgtccaaagcgaaaactttttcccctttacgctgattcctttaaaaggtttaagcggaatttctttaaagttattgctcaacccggccaacaacctttctttctccaagggccggagtctgccggggtaaagtggaaattcccactttattggtctcgtgcccatcatgaactccatccctctttctatcacagggatgagaccggtttgtcggatgaggacgcctattcggttattcagatcgacgctttccgagagggtcagggtttttgtgatatccctcggactctttctgattgtcagtatgaatgtttttattttttgtctttataattctttgtaactgttgattatagcattgctttttcttgcagctgctgaaatggaaaaccagactgccgatccgaaccctcgatcccgcaacacctctggagcccctcgccctcctccgaccaatgctgccccttcctttttcaagaacttgaaaaggaagaagatgactaagtcaaccactggggcggttgacagctcggccacagtggcagtacaaattgaagcggccacctcctcggccactgtagatgttacccccggcatggccaccagctcggccacgttcgtccggcgggtgagtatacctccattattcccccggatgcttcgaagctggagctcggccatttatgggagcgaggggttgacgagttgtttcccttcattcaagctcctaaaaggtatgccgactcttctcggctttctgatgaggaggttcgccaccttcgacagatgcagcagtatgccatacaaacggcgtccttggttgattgtcttgtggttaccaaggataggtgccataaacaaaaagaagagcttgctgctgctgaagttaagctccaaaggtccgaggatgggttaaaggccgcccggggtcaggccgagcaggctgagcgggatcttcttgcttcccgtttcgaaaccgagcaggccctctccaaggccgcccatgcggtccaaaatatgaacgaggtgaagaccttgcttgagggtgccgaggctgaagccagggagaccaagttgaagctcttggcgtctgagaaggaggtatccgacttgtaggattctttgtcttcagcggccgaggactccttcaacaacgccatcgcccaggttctgtgtcttaaccctgggatcgtgctgaacaccgaaggtcttcacttccaatcttttgttcgagatggtactgtggttccttattttgaacaagaggattcggtcgtggtggccgaggaagttccagaggccggggctgaaggagactcggcgccagcagggggtgcttgaagggccgggatgccggttttattttgtattttgtttatttggtctgttctttcttttgccaagacttctctttaccaaacaatcgaagtatttcaattctctttataatattgtgttctttttagaactttcatatgtgcatttatattttttggctccaacggccaagtataatattgtccgatttactttgtttggttcttgggttacacaagtttcgtcagtacaacacggccatcgtcagaccgtgccaacctgatcggggtttggaagtacctcggttttacttgtgcaataagaaatattttgatctcgtccaactaggatccgatctcgtccgagtaggaaacgaatatatacgatatttgtcttcgatttgtttaaaaacataagttatgaaaaacacaactttttaacgtgaaaaaccttctcaatgtgagaaataaaaaccacgggaccgatttcggagtccacccaaatttttcactattttcgtaaagtgcttacaactctatgatcctgatgaaagagattacataatgctagggtgtcaacactcgaccccggcttttctcaattaacaggaaacccatagataaaattattaactagctataataagctttcaacttatcggcattccaagtgcgtttgatcgctcgtttatccaatgtttcaagcaggtatgctccttggccgatgttctgaacaactcggtagggtccttcccagttggccgctaattttccttcctgagcattcttgttgccgatgtcagcccttcttaaaaccaagtcgcctttctcaaaggatctcggcttgatcttcttattgaatctcctcgccaccaatcgttttgctgccatgtctcggatgtgtgcctgggctcggacctcatctgccaattccagttcaccgaccaaagcctcattgttggcgtcctctccttgtttaagcatcatcgttcttctccaagaaggttgtccgatctccaccggtatcattgcttcgcatccatacgtcattctgaaaggtgtttcctgagtggatgattgagctgtgattctgttcgcccataagacataataaagctgttcgacccagctgcctcctgcatcatgcattctttttctgagtccttctaggataaccttattggctgcctcggcctggccgttggattgtgggtgctccacagaagcaaaatggtgctgaatatggaaattgttcatcatttgtctgaatttcttatccgtaaattgggtcccgttgtctgtgacgatctcagccgggatcccgaatctggcaaggatgtttctttcaaagaacttctgtattcgggccgatgtgatggttgccaatggctctgcctctatccacttggtaaagtaatcgacggctacaatgagtcattttaactgtccttctgctgctttgaatggccctagtaaatccattccccatttatagaaaggccagggggacgttatgtttgttagctcggtcggggaggtccatattatcttggcgtgtttttggcagctttcgcacctcttcacatgattctgggcgtccgctttcatagtcggccaaaagtatcctgcccttatagctttcatggcaagtgccttaccccccatatgttggccgttgatgccttcgtggatctcggccaagatatactcggcctggtcggtccctacgcaaagcagcattggggtgtgtgggcccctgcgatataattccccttctacggtggtgtacaaagcagcttctctgaccaacttcttagcctcggtcgcttcctccgggatgattccttgttctaggtaacgaactataggatatctccagtcggaccctgttgatattatcatgatgcatgtggggtggcccatttcttgctggatgactgttctgtgatttccttcacccttagtgcttgctaatttggacagtatatcggcccgcacgttctcttccccggggatgtgtgagatagtaacttcatcaaactcggccataatctccttaaccctccccaggtatttgatcagcaaggggcctttggcttgatatcttccatcaatatgggccgctacaagttgggaatatgtgaacaccttcaccttccgagctccatgttcttgggccgaggttaatccggcgatcagggcttcatactcggcctgattgttggaagtcgggaaattgagccgcagagactgctcgactgctaccccttgtggattctcaactattacccccgctccactgccttttgagtttgaggacccatctacgaagagagtccaggtttcttcgttgtctgatgccgacggagtgagttcaaccaggaagtcggccagagcttgagacttgatagcctgccggggttcatacttcaagtcgaactcggacaattgtatagcccagctcatcattcttccagctaaattgggtttgtgcagaacttgtcggatcgactgattagtacgtaccacaatggtatgtccttggaaatatgggcgtagcctcttagccgctgtcaagagtgcaaaggctaccttttccagcttctgatatcttagttccgagcactttaaagctcggcttatgaaatatacgggcaattgagatttgtcggcctcccttaccagcaccgcacttactgcttcttctcctactgacaagtatagaatcagtgtttctccgggttctggtttggatagtactggaggtgacgagaggcacttctttatctcttggaaagcggcctcacattcaggattccaaccaacgcgagcttccttttttaacagtctgaagaatggtagggccttctcggccgacttagggaggaatcttgtcaacgccgccaacctgccagtcagctgttgcacctcattcttagttgtcgggaatttcatgtttaggaccgcagcgcacttgtccgggttgacctcaattcctctgtgtgttagcataaaccccaggaatttccccgccgttactccgaaagcacatttgagcggatttaggcggatattgttcagcctcaatcggttaaaggtttcttccaaatctcggatatgatcgccgagcgaatctgtcttaacgatcatgtcgtcaatgtacacttcaatattccggccgatctgctgagcaaagactttattcaacatacgctggtaagtggctccagcgttcttcaaaccgaaaggcatcacattatagcagtagtttgcatctcctcctcggaacgccgttttctctcggtcgtcggggtgcatcggtatttggttgtatccggaataagcatccataaaagacaacagcttaaatccggaggagttatcaaccagctgatctatgttcgacattgaataggaatctttaggacatacgttgttgacgtcggtatagtcaacacactctccatttgccactgggctttttgaccattaccacattggacaaccatgtggtgtactggatttctctgatgaacccggcttccaacaattctcttatgtgctgttccaaagcctgcttccgttcagggccgagatttctcttcttctgagccactggtttggctccgaggtacatggataacttgtggcaacagaaagcgggactaatgcctgggatttctgaagccgcccaagcgaaaaaatctcggttggcacgaagacattttattaactctcctcgataggtcggatcagctatattcccaatcttggtaacttgggtagcttctggtccgatctgcacttctactagcttgtcggccggttctggtctccattcgtccactttttctcgcatgtcgagctcgaccagatttatgggctccaccagcgatttcccctttttcttctctgcttcttctcgacctccatggctgaggtgaattgtggaagggccggatctgttctcctttactgcgttaaagtaacactgtcgggattccttctgatctccacaaatagtgactacgcttccattattccctatcaacttcattttctggtgtttggtagacatcaggatatcccatttatggagtgtgtgccttccaagaattacgttgtacggggaagggaattctcccacaacgaacttcactctttccgacttgaacccttctttcatccccaaagttaatcgcaacatgatagaaccttttactgaagtgctttcgccgttgaagccggaaagcactgtctggcatggctttagatcttcttcgtccaggttcatcttcttaaatgccgcccacgatatgatgtcggccgagctgccattatcaacaaatatctttttaactcggcaattcgctatggttccagtaatgaccaaaccatcttcatgtccgggaatcacatcctccaaatctgccttagtgaagtagagaaggggcggttcggttttgtcgtcggtaactttaaacttgggttgctctcttactgtcaagactttcctgagatacttgcgacgctggttggtcgtgtcacctcctccgcccatggcgccagtaatgacattgcattcgaactccgattctgggaactcttcgtcagctggcttcttcctcttctcactttggcctttttgctcgtcaatagggttgctctttctctttccttgctgcccctgggtcttaatcacatatcgtcgcagctttccttctcggatgaacttctctatggcgtcgcgcaagtcccaacactgatctgtggtgtgtcctggaccattatgaaactcgcaaaaacgcgaatagtccaaaccgatcttcttgaatacaggccgaggtcggtcaacttttttcatctcggtcagggctacctccctccacacctgagcccgggaagtgtttagaggggtatatttgtcatatttattctcatatctcggtcccggcctatgtccagcatctgtattccttggtggcaagttcccgagttgcggacggtgtttggggggcgatcccttcctctttggggcggtattggcaatctccatctgttctagctccaaatacttttttgatcggaccctgaactccaacaaagttttaaccgggtctttgtaaatagatttcgcaagccgagatgatccattcagtccggctgatagcaaatgaacgtgcactttttcttctaggccttgcacttgcaaggcggcctccttaaatcggtctagatagctctgcaacgtctcccccggatgttgacggatctttccaagaacaaactcggacttgggctgttttttgcttgttgcaaagttgagcaggaatctctggccgaaatcttcgaagttgcgaattaaccgaggggggagcgtgtgaaaccatgtctgggctgccccggtcagagtagtaacgaatatccgagagatgatcggctcatcaattccccggacacacatctgcatgtcgaattcgtcaatgtgcacctgtgggtcctgacttccatcatacttggaaaggaaggatccgtcaaaatcttccaaaaactgcgcgttaactatctcgtccatgaacgggctgttgttatgttgtccacgtctgtatttccttcggtagacctcggcacctccgccaggcggacataacgctccttggaaagcatttggtgggcctctcctggctgcttcatgtggatttggtacctcggcatggaatggtacgtggtgaggttctaatgtcggacctcggtgaattgtcggctcttgagaggggacatccatgtggccgatgcgctgctccattctttgaagtcggtcctgctcgtccaacctccatctcgcacaacgctcatccagctgtgccatcatatgattcatgtcttcttgtagttggagggcgtgtagcctctcgagtctctcgattcgggaaagaatggtttgcaacgcattattggtgaggcgttgcatggatccttggtccacctcggctggggtcggcaaaacgttctcggtgggtacgggaattgggttattccgcgcacgcgatgatgccgtgtccgacaatgcgtcttccacccggatcgaatgtgtccttccaatctcgggtgggccttcaatcagctgtcttctcgtgtttaccatggtgggaatcgaagtttaacgttccccacagacggcgccaatgttccgttcgttacaaacggaggtccagtaatgaaactgggtcttgatgtatgatcaaggttctctctctctctctgaatgctatggaggttgaagcacccagaggaagatgaagatcacagcaaacaacacgacacaagtggcgtgcagtgtgtgcttgtgtgaaaggaaaagagagagtcagaatatgtgtgtgtacctttcacctttgatatgaggggctatttatgctttcactgacctgtgtttaaatgaggaaacctttgtcaattcttgatcgtgatctgcaaaagatgagcatatattttagatatttgctgataaaataatctcgaattgtccttgatttggtgcagatttaaggccttattctttccgttaataacttcatcttgactgttttgggcctcatggtcttggcccaatatacaaattccataacaccattgaagaattaaaagaaaccctgtgaaaaacttcaagaacccggttttgaaggagtgagaacctgatctggattcccgtggcgcggcctgcgaaaatctgacagcggcgcagcggtgaccacttctccttcaatcacgctatcatcctccgcggcggcaactgaaagtcggggcagatcttgattcttcatgctgtttaaaggatggggctgaaagtatcgttaaaaaacataaggatgtcgtgtaataagtccaaactttgggaaagttcttgtaatttatgcttgtttaatttaaacagaaattaaacgttagggagatagcctatgtttcttttgtgtctgctcaaattgagatggcgttagggaggtaagcattgaacatcttagactcaaaatctaaagttgttcttgtttaaagatcacctcatttccttcttgttgtatcattctatcattctttttagggtgtccttacttattatatggtaaaactatcctccgaagggtgaaatacatctaaaaattactcccatgctcaagttaagtctcagcagagagaataataaatgtagtaagtgactggataaaataatctgtgttactttgagaatgtaatcttttatatatatatatatatatatatatatatatatggagcttatctcttaattaaggagacaaaatatgtaattacttgataatattaatatagtatagtattaagataagataagttaaattctttaattttaatggagtgattgaggatactatcactacaagaaaaatcgagcattttgacggagtatttcccatggaccaccttccatcggaattggcagccttacccacggacgataccgacaaagcttagttggtgggaaaaattgggtgtttccgacggaagtttccgatagcagctttatccgtggaaaatttcatttatacggatcacaaaaggcccaaccctaatttaccacagaagttccttgtttcgtgaaagcctgttgccttgttaccctgtgtgtcgccggcgccgcaagacttcaaccaccatcagcgcaccctcgcatgcgtttcggaagcttcagctacgcaggttggtgtcttcttcctccgtcagcgcaccacagtcccgccaagctcaagctgtggtgtcttcttcctctgtctccagcgacttagaagccaaacgcacaccactaagcaccgccacgacaccaccacaccaaccacgactaggtatgctttgctgctttcaggtttctctagtcccacaaacaagtaacaacatttaacaaaacattagggatttaatttatgaaacttaatttgttcttattgttaggtccaaaatagatatatttagtgttttaacattatcgttaattactactaatactaaagtcgaattaacacaacattgtagtaatttatcattaattcttgcttgtgttgaactaaacatgaatatttactatatgatgatgcttacttctctgtctgactcttttaatatgagtaaataaagctggtaaactttgtggccttgtgggacagtcccaatgtctcttcctctcagcaatcccttttttctcgatctatttcctgcaccataggtgtgccttgttggtcatgtccatgtctggcattctactttcattactttcaacctcatcttattgccactgattatgctatggtatcacttattctacaatacatttacatgcatctattaaagtgaatgctgagggtccatgcttcatatgtcttttgggtatgcttggatcagatggagggtagacctattgctagaggtaaagggagacaaaacactataggtgtaaccattgagaatattttaggggtcattggtttgttaatatacatgattcacaataaaaattttatgtcattcgatccatgtagctgactccacttaatgggaaaaggcttggtagcttggttgttgatgttgtagtatctatgcattccctgtgtacggatttggcatctcatgacccatttctgttattaatgcatattagaatgtaattgtatagtgttttaaggtcttcaacaattatactcacatttgttgtctgcagggcatgagagttctgttgtatgatagtcagatactaaatttagctgagggtctggttagttttggttcttatcctcttcgtttgtctccagtggggataattgcagaattaggcagcaacaaggacctccactcaacaagctcaaaggttatgcatatacttgtgatagatttcatagtttgttgtaataactgtctatgaattgaagcggatttgaatcactgtctactataataactttttctcatttactgagttgtagaatttgtgttcttgttagctctttgctttactcggtatgtatcttagctctttggtggttttgtttttatgtatttaggtttttgggaccaacactgtatccacccttggttagtctcttcattggaagtttaatgtcttctaaccttggggtgttgtgttgggtttttcctgagattctcatgtactctgttctctggtacttctgttaccattttaatataatgtctttaccaattttttttaaaaaaaactcggtatgtatcgtttgtcttagacaacttgctgctagtttttcaaattgcaaatgatcatagaatggcttgttgaatgaccactttgacacattcccatatgtgttaagcatatatagtacttgagactagctacttatgtcatgagaggttgaattccaacttagtttttgacctttgatagatatatgataatattacgataattgagttgtcaaattagtgatcacatggttttagcaacaaacttttgtctgttggaattccgtcagaaatttcattttttcgacggattttatactttagagacggattttttccgtcggaaacatcaattttttttttgtagtgtatactatgcttcaatagcctggttgtcgaaaggatattagacaatgctaaaaggattccaaattgtgaccgagaggatactatgtcatgcatacagaaggggcgcataggtcatgccaaagaagacacgtacgttagagtatcacactgcatatgaaaaatatattatgtttactcttaaatattcatatatatttatttgtaaaaaaattaagatagattaataaaaatatatttgtaattaatgtcaatctaacttaaaatctatagaatttataatattattttattaatatttaattaaaatacactgttattcacatatatatatatagatattatcatatatgataaattttttataataattcatttaaaagttatatatagaatgatttttttattgattaatatgatataaaaaattgtattgactgtgaatgaaaattaagctcttaaaaataaatatatattttgccttaaatatattttttatttctgtaatatactatttttttggtttaattctttataattttgtttttcaaaatggacctcgtaaaatttcatttttgattttattctttgttattttattttagtcattgtaatgcactattttttgttttatttcttataatatttatttatcttgaattagtatcttttttgaaaaatatttaataagaactaaaagcaaatagtctatatattacaaggaaaaataaaagaaaataaatattataaggaattaaaatatatttaaaacatatatttaaacatttttcatttaaagggttctctctctctctctctctctctctctctctctctctctctctctctctctctctctctctattcctatttttaaaaaattcaaaatttcattttgtgttttttgaataaaataaaaacattgaacgagttttaagcataacttaaatgtgtaatgacattttgacatgtctttagaaacaatttaaaatacaacgttgtttggtaagaatttaaaatttatgaaaaatcataaaattttgagtcttacgttatatataggaaggaacgtggtagctttgggcgtccaacatcttgtactttcccataatcacccaatagctcaaacatggttttcactaagctttcattaattcgtctgattttctgttcactcctaagcctccattcctcccaagttttcacgttttcatcttttgcctttgctgccatcactgcttatgaagggacggaagcaagtgctctacttgagtggaaagctagccttgacaaccaaagccaagcttctctgtcttcatggacaagtgctgtcagtccttgcaggtggaaaggaatcgtttgtaacgaatccaacgctgtgaccgtcataaatgttacaaatcttgggctaaaaggtactcttcacactctcaacttctcttcctttcccaagctgctaactctggatattagtcacaacagttttagtggaactattcctcagcaaattgctaacttgtccagactttctcaattgataacgaatgctaataattttagaggctcaatccccatttctatgatgaagttggctagcttgtcaattctaaacttggaatacaataagctttcgggctctattcctgaggagattggagaattgcagaacttgaagcgtctaatacttcaagggaatcgactttctggtaccattcctccaacaattggaaggttgtccaaccttgttagacttgaattgtccaaaaactctatctctggtacaatccccacttcaattacaaacttgacaaatttagaactccttcagctctcactcaatagtctttctggctccattccatcctccataggagacttggtcaatttgattgtttttgaaatcgatcaaaataaaatttcaggattaattccttccagtattggaaacttgacaaagctggtcaatatgtccattggcgataacatgatttctggatcaattcccagctccatcggaaacttggtcaatctaatgctcttagaactttctgtaaacaatatttccggagttattccttccacctttggaaatttgacaaagctcacctatttagtagtgttaaataacagacttcatggtagattaccacccgcaacgaataacctcaccaatttcataaggttacaactatctagaaacagtttcactggccctttgccgcaacaaatttgccttggtggttctcttagcagatttgctgctaactataattatttcacgggtccagttccaaaaagcctgaaaaactgctccagtctttacagactcagactagatggaaaccagctgaccggaaatatatcagatgcttttggtgtatatccagagttgaactacgttgatctgagtagcaatcacttttatggccacatttcaccaaactgggcaaagtgtcctggtctcacaagccttatgatgtccaacaacaatttatctggtggtatacccccagaactcggccaggcacgcagcttacaagtactagtcttgtcttcaaatcatctaacaggaaatattccagaagaacttatgaacttaaccactttgtcgaagttatcaataggcgacaatgaactttctggcaacattcctgcagaagtaggagccttgtcaggccttacaagtctcgagcttgcagcaaataatttaggtggcccggttccaaaacaggtgggagagttgcgcaagttactttacttgaacttgagcaagaatgaattcactgaaagcattccttcagagtttaaccaattgcaatctcttcaagatcttgaccttagtaggaatttgttaaacggaaaaataccagcagaacttgcaactttgcaaagattggaaacactaaacctctcacacaacaatctctcaggagccattcctgattttaagaatagcttggcaaatgttgacatatctaacaaccaattggagggttcgattcctaacattccagcctttcttaatgcttcatttgatgcattgaaaaataataaaggcttgtgtggaaatgcctccagtttggtgccttgccacaccccacctcatgataaaatgaaaagaaatatcatcatgttggcattactcctttctttgggcgctctatttctattattattggtggttggaatttcgttatgtatttgctaccgaagagcaacaaagtctaaaaaggaggaggataaaggagaaaaaagtgaggatcattattccctttggagttatgatggaaaattagtgtatgaagatatcatggaagcaacagaggggtttgatgacaaatatctcattggagaagggggaactgcatctgtctataaggcaaaattaccctcgggacagattgttgctgtgaaaaaacttcatgctgcacccaacgaggaaacacccgattcaaaagctttttcaactgaggttaaagccttggcagagatcaagcaccgtaacattgtgaagtcacttggatattgtttacatccacgcttctcctttttggtttacgagttcctagaggggggtagcttggataaagtactaaacaatgatacacgtgcaacaatatttgattggaaaaggagggtgaaggttgttaaaggtttggcaaatgctttgtaccatatgcatcacggttgctttcctcctattgttcatcgtgacatatcaagcaagaatgttcttatagatttggattatgaagcccacatttgtgactttggaacagctaaaattctgaatcctgattcacaaaatttaaccgcatttgcaggcacctatggatatgctgcaccaggttatgccctttttgtttttaagaagttaatcctataaatactcgtttcaataataagtcgtgctacttcttgtgtaatatcattttcatattttgatattttacagagctttcttatactatggaagtgaatgagaaatgtgatgtttttagttttggagtgctttgtttggaaataatgatgggaaaacatccaggagatctgatttcttcattattatcaccctctgcaatgtcatcagtgtccaatttgctgttaaaggatgtgttggaccaacgactacctgatccagtgaggccagttgttaaggaggtgatcttgattgcaaatataacattagcttgcttacgggaaagtccacattttcgcccaagcatggaacaagtgtataacgagtttgtgatgccaacatcatcttcagtgaatttattctccatgatcacacttggtcaactcagagataattgaaccttgttttatggtgtattgtaagctttttgttatattaatgtttgttgtgtgcgtgttttacatgtttcttctattttgtcagacctggaaaatattgcaaagctgtcttatgcctttaagtaagaccccgagtctttattttgtaggttgaataaatacggtctagttttaaagggagacagtagtgatgtcttttaagtaattaaggatgttttgactatatatttcaacattaacgtaccacttgaactctcttccaattcatgatacatagtctaaataccatttaggactatggccaatttgcaatagtgatttttattaaaatctcttgttcaaaatatccttatgcgaattttcttgcagattaaccatagatctaagtgatattcaaaatacagttgctacaaaggaagcagtttgggattttagcgctagtcttcactcttcagtacggcgtctaatttcaatttttctttttattttctaatcaaatctaactagtttgggattttagcgattaactttattttttttttaaataaatccttcaaaaatctgaaattaaaataagctaaatcaaatgcattacttcaatatatgcttccttgattccgatcaggtagagcactcttgcacgcggccccaatttgaacgtaattaattatagtgccagctgttggattaattgaaaatatatactttgattattatctcaaactcactcaaaaaattgaaccaagttgccaacattggaccagaagcgaggaggaaaaacaaaaaaaatctggacctctcgactttgaaaatccaagaaaaccttatctccccttatcctaaacaagatcgcacgttggtatcttgattggaagaacttgtattgaatggcaaagtatatgataatttcgtttctattatatattatgtatcatgtttgatttgtggaccttacaactacacaagtcttttcacaccacgtggtgggaatgttaatttgatttgtatatataccaacctaaattagacaagacacgagtatcataaaacaagcatataaatgtggaacaactaccacttccctacttggcccattaacaacatcattatgaacctcaaaatcacattattatagtttgagtaaattatattcgcatttcatatgtttttttttttaaattgcattcgatactctttttttattatatattacttttatcttattctgttaacattgttaattaacgttaattaaaatatttgaatagacaaaattgttcattagagtaaattatactcgtacccctgtattttttttttaaattgtaggtactcctccttttttatacattattgatctcgacgtaggcattaaggctgttaatgttattggccctgacaacgtcagtgttcagggaaccagacacaatggtgatggtggtcgaagctacaacaggggacgaggaggtgatggaggtggatatgacggtggtggcagcgattacggtggaggtggttattccgacgagagtggatggggacgacaataaggagaaagagatgatgttgtcgtgggagagggaggaggaggaggagaaggaggtggtggtaagtaaagaaggattgttgaagaagatgaggatttgtaaaactcaatatttgattttaaggaagaagataaagatattttagatataaattttcatcaaaagttatgtgaccagcatatgcttattttcttttaaattattaaattgtatttaggaaggagaaagtctggctgtaatataagctaaataattaaaagaattttttgtagggtgtaaaaaaggagaaatatgcgagtgtaatttactcttatagttttcacactatttaaattgatggaccaggttaaagtcttgggcaatttcaatgtagataactgatttgtgccatcctagtgatgccgcctgcagctaaggttttaacttgtggtcatgattagcgttgcgttttcattataatcgttttcattgtaatctttgtaatgtgcaaaattgcagataatacacaattaatgcagcctcagttaatgtaatggtagagatctcaatttttttgacgttgcagataaataaaatctttttaaaaccttggatgcagcaagaagtacatatatggtcaaagaaagtgggactaatatgccatacatgtatttaatacttaatactttgtttctttaagcattcttgagggaggaagaaactagccaagttctaaaatgagaaattaagctgtagtaacaaacaaacaaaagatataatgttgtgataccctgacgacaaattattagcacagtgcaaaagattgaagaagctggcgcaccatgtatattgcagtccacactccatgttatatagagtactaaaagctaggctactctaaaactacataaaactactattaaaacggaagagaagataaaagataacattgatatttttcattcatgatgataggtaaaggaaaatacatttagatagtactaaatgatattaatccatatgtggttctggtgaaagagaatcaatttagtgacatttcacacttcaactactatactttttctgtggtgaatgtgcatttattattattattattcatgtgttttggaacgttctgaaaatttataggctttgaacaaatgttttactgtttggttgttcttttgcatctcttccctttttaggaatgagaagggactaattttcaggtgtttcgtgtgcaattttgaggcaagaatcgtggtattattaatcaagaatttactgaggtgtaaattcctcctaatttgatgtttggggcaccagacgtaagctgtttttttccctatcaattttgaaattcctcatattttgcctaccagttgttttgtttactcgttttcctaattatggcagaaagtcaatcatagcttttaagttcttatttatttacatgttaatattgttgaaacaaatgattttggagaataatgtgtttaaactccatgaactactgttctttcacctttgcatttatatagttagttttgttgtatttaaacaggttggtcaagatgacatgcatcacagtatactctattgatatgattccctaaagttataacttttgtcgcataacagggaaatccttcaatctaaatttgattaatgaattgcaagagttctttagtgaggaattgtcatcattcatcaagtattgaccaagaagatgccgagatatccaagatttttttttgagtttagtgaaaactttgcaatgactcttatgataaattatcgtgcagttgagatgtcaaacagatcaaaattaagtggtgtttgctgaaatactgtcttttttatataaaatgaaagaaatttacattggttttgcttgatcctcaaaatttccaacacttctttgtatatgtatgcttaagaataaagaaaaaagatgagtataagacagcagtactttttatggactataataaagttatttacaagcaataataaaggacagtgaatgagtacaattggaatttggaaagctacttttagttattaggattgccagtaaacatacataggtttcaccaaaacgggtaatggcctttaccagcattcattataatggcggtaaacccttttccgactctggaaaaggtgacatagtctaatagccggtaacactttttgagggaatttatattgcggtaaatggtatataacaattgccggtaaaagttatttttgttcacattgtgaagttaaaagggttctgttcacacttcacatccatgcttttcgtttctggtctgagttccttgaatgggggagtttggacaaattactaaaggatgatgcaaaagcaataatgtttgattggaataggaggctgaatgtagtttaaggtgtggaaagtgctctataccatatgcatcacggttgctctcctcctatactaaaacgtgacatttcaagcaagaattaatgttcttatagacttggaatatgaagctcgcttctctgactttggagctgctaaaattctgaatactgattcacgcaatttaaactcctttgtagttgtaggcacctataggtatgctgcaccaggtttggcacttcatgttgctcttaagacatcaatcttatataccatatactcttgtttcagttactatatgagtaattttattttcatattttaatttatggtagagcttgtttatactatggaagtgaatgagaaacatgattgttgctcttttgttttggtgtcctttctttggaaataatcatgggaaagcatcctgttgatctcatttcttcattgttttcattgtcaacaacaccatcagcatctaatttgttattgaaggatgtgttgtaccacaataaatgttaaaaaaaattgggttacaagttactcttctcaatctcaacttgtcatcctttcttaacttgctcaatctggatgtaagtttcaagtccttgcattggcatattccccacaatattggtcagttgtccagagtttctcaattgaaaatggataacagtaattttaatggttccatccctctagaaatagggggaactgagaggtcaaagtcaccttgacatctccaaatgtaagctaaacgggtcaattccagtttccatagtaaagcatgccaacttattatatctagatttagctggcaacaacacttgatttgtcaactaataatttctccggagccagcccttcacttaggaacttgagaaacttaatgcaacctttcctatttaacaaccatctctctggccccattcctgaggagttgggaaaacattattctctcaaagcaatcaaattgttgaacaataatttgtcttgcccaatcctatcttccataggggatttggccaatttgagcacacttatgctcagtggtaataaacttgggggatcaattgcttccactctttggaaatttgacaaaacacactgaattggtcctaaagcaacctaaagcaaaaccatctttctgggtaaattcctgtttccataggaaacttggtcaattttcagaggcttcgcctctcagaaaaccaactttctggaactattccgtccacctttggaaatttgacaaagctcacccatctagtgctcatcacaggtccagttccaacaagcttgaagaattgttccacccttgtcaaactcatacttggagacaaccatttgacaggaaatatatccgacgagtttggtgtatatccacatttgaacaacattgatctgacaaggaataatgtttatggtcacatttcaccaaattggaccaattgccatagtctaacaagcgttaaaatgtctagcaacaacttatccggtggtaaaccaccggagctcggccaggcacccaaattataacaagttcaactttcttcaaataatataagtggaaaaagtccaaaacaaattggcatattgaccctgttgtttgaactctctttgagtcacaatgaattttctgactacattcccacagaaatgggatctttgctaaaccttcaatgtttgaagcttgcagcaaatagtctaactggtccaattccaaatcaacttggacgacagcgcaagttaattgacttgaatttggcgataataaattatcacatggccttccgtctggatttaactaattgcagtctcttcaaactcttgatcttagtggaaacttgttaaatggacaaataccatatcacttggaaagtagcacagattggaaaatttgaatctctcgcacaataatctctggcaccattccatccaattttaggaatttgttgagttagacaaatgttgacatatctaacaactaattagaggttccaattcctgatattccagcctttcttaaagcctcatttgaagcattggaaaacaataaagacttgtgtagtaatatctcgggcttgacaccttgccaaaagttgagtcacaaccatcacagtaaaaggaaaaatgtcatgatgttggcgatttccttgacctcgggtgctttatttctagttgtggtcctggttggaggttcattatgtattcatcaccagggagcaagaaaatcagaaaaacaggttataaaagaacaaactcaagattatttttccatattgggttatgatgaaaaaacagtgtatcaaaatatcaatgaatccacaaaggtgtttgatgataattatctcattggaggaggaggaggttctggagctgtttacaaggatattttatcatctggccatgtcgttcctgtgaaaaaatttcatgctgcaatggatagggaaatgctcaatttaaaatcttttacaagcgaagttcaagccttaacaaatcaaacatcataacattgtgaagttaaaagggttttgttcagatccacgcttctcgtttctggtctctgagttacttgaagggggaagctgggataaagtactaaaggatgatgcaaaagcaataatgattgactggaatcgcagggtaaatgtagttaaaggtgtgtaaagtgctctatagcatatgtaacataattgctctcctcctatacttcatcgtggcatatcaagcaggaatgttcttatagacttggattacgaagctcgcatctctgactttgcaactgctaaaattctgaatactgattcatgcaatttaacctcctttgtaggcaccaatgagcatgtcacttcatttttccctgagcttttgtttgagagaggaattttagaggggaagggaaggaagggaaaggtttaggtggtgacatcttcttatttgagagttttaatttttgaggaaaaagattttaaaactcctctgaaatctttcaaagtctaaaaattgttgtcccctaatttaaaggtttttagaaggaaaagtaattaaaattattatcctaccccaactacacgttcaaaaatatattaaaatatatttttaatatatttttacatttaagttatataattttttacatttaatatcttattaatttttcatttttctctcttaatatatttttaactcccaaacaaggagaaggaatttctctcattttcctccccttccttcccctcccttcctcttgaatctcttttcttcccttcctctcataactcccaaacaaagcctaaaaaaattaatcttacacactcttgtttctacttctaatacgagcaattttattttcatattttaatttaatgtagagcttgcttatactatggaagtgaatgagaaatgtgatgtctttagttttggagtcctttctttgaaaataatcgtgggaaagcatcctggtgatctcatctcttcattgttttcattgtcaacaacgccatcagcatttaatttgttattgaagaatgtgttggacccacaacttacgcttccaatgaagccaatagctccgtggttgatcatagttgcaaaagtaatatttgcttgcttgattgaaagtccacagtctcgtcctaccatgaaacgtgtgtcaggtgtttgtgaattgtgatgctaaaatcacctttaatgggtccatttcctgttatcacaattggataactctaaaataattgaacttggatttattttgcattgtaagcattcttgtctttctgctttgtaagaaatcatgtaataccgcatagttataggattattattgtaacaattgtactaggcatgggtttaagagcataacaatagaaaccaattattcctattatattttacatgtttaatgcattaacttaataatttttgtaagaaaataacccaattgtttacactttcatgtgattcatgttttgacatctttagttgaaaaatagtatgattgcacttacgtatttgtgtttttaaacgtaaaaaacgtgcaaggaaacagaagatgtccaagacttagaaagaagagcaagacaaactcacaaagaaagtcaagtctaacttggggactcctgtaatgtaactgggatgatcttgatgtttgaagaaactttaaacatagatttataatttttatggagcttagttttttcttttggttgattcatggagagactctaatcagatttaacacggatcatacatgaaatggggcttaaagttgaagttgatgccctatcagagagcttgtcataggatataaattaattgaattgattttgtttttcctcaaagaatcttaaaaagtaatttaagtaaagtcataattagtttaagtaaatcttaattattatttttttcttatagacttagaaataattaacaataaatttacttctagcatatatttctcagtaggtaggtgacgtacatttcgtacactaatcattaattcttcacattaaaatcgtccttcctgaaaacggtgaaagcagagttttgttttttaaattaaagatgctcaaatattattgatgaaatagagaagatagaccattgctcatgatttggttcaatttagggttattcgcgggtcggttcggatcaattttgattaaatttaggatctaactgaatcaaatttgatcggctcggttggattcgatttttagaagaagaaaaaatagaaatccaacccaatccaactcattcatcaacggttcggtttggttcggatcactgggttacccatttaattttttttagaactactattttatataacgattctttcaaatatcccatacaattaacacaatattatcaaatgtatgaaagtagtaaaattgattcatttaatactgttaaaaatcatatatgcataaattggaataataattcatgattcgtttcattcattcatttgttctctctcatctatctttcctcaacatgaggttcttatataagagagaaattcaacaaaatgctaataatacgggataataacaaactgatctaatcttaattcctattcaaatattaaaatataataacaaactgtaacaacataataaatcataacaataatttgaaatttaaattatacaattcaacactccccctcaagttggtccatgaatatcggtcatgcccaacttgtcaattgcttcttcaaacactcttccaggaatgactttgatcagcaataggttcaagaggtgcttcaagatagtccacgtgcttcggttatgtgaggtagaaagaaaattgaaatacgagaagagattcggaacaataacatgttcatgtcaataaacttcagggatggtctatgaagattcagaacaatacaactgacttcacatcaatgaccttcaaatagaatacgtgcaaggagaattgagatacgagaatggattcggaacaatcacatgttcatgtcaatatacttcgagtttggtctgtgaacaactcagaacaatggaacgagtttcacattaatgacatttaaatggatacgagaaggatacgaggcaaaaatgaaatttatgataataataatcataatttgtaaaggaatcgaagaaggtgaaggttaaggaggagatagatgattaggtataagtgaaatatattgaagataagataaaaagatagaaggagatatacgtttgggaatgtgaagaagaaggactttgaaaaaataaggcagcagaaatattatttttttcatggaggattcatggaggataccatgattctcattcatgaaagaattatggctctgataccataaattggaataataattcatgattcgtttcattcattcatctgttctctctcatctatcttccctcaacatgaggttcttatataagagagagaaattcaaaaaaatgctaataatacaggataataacaaactgatctaatcttaattcctattcaaatattgaaatataataacaaactgtaacaacataataaatcctaacaataatttgaaatttaaattatacaattcaacaaataccatcaacataatattctaaaatagacttataatataaattaaaacaaaagatttttgaacaaaatttactataatagtctgaatcacaattgtttcttacaaatcaagctttgttataaccaatttttttacaaccatatttactgaaacaaacaaataaacaaaatatgattcattaatattataaacatgataaacaaaatatgaaaaaaaaatcataatcttaaatcaattcttatttcaaagcaacatattgttagtacattggttcttctgatcaaattttccattattttgttttcagctacttaaagttttaaagtagggaacataactcaaatgtctaaaatacaaggtcctaaataattagttgagtgccatgatttatttatataaactgtggatgaccaatttaagtcaattgagaacttttttaattataaaaatttgctattaaaactttaacatatgaatattgtgttggtcctagatgaactcaagagggggtgaattgagttttataaaataattaataattaaaaatcaaactcaaagcaataatatggaaataagagataaagaagacacaatcaattttaacgtgaaaatccaaatgggtaaaaaatcacgatgtccaaattagataatcaattcaatggacaactcaactatgataattttgtatacaagagtttctagtatcctagtttcctagtctacctacctttacacaacaattatcccacctggtatccttgtttcccagcaaaaaactctagtttcaattcaccaagaatagagaaagactggtatcattgttttccaaccagactggtatcctagttttccagccagaagtcgtacgtctcaattcatcaagaacagagacaaaattgatatcatagttttcctgctgcgaccttttccaaagtcaagaagaataatacaataaaatagttaccaacacttctactccttaagcaaataggtacctttaaatcctgatggagagttgaagaatcggacttgacaaacgcttctatatgatatcacagcaaaatatctcaatgataaaaacttaaactttctaaaactctaatattatttggaatggaatgcatacatgaacaccaaaatatgtttctatttatactaatttaaagatagattttaaccaatttttgaatgtaatcctaaatatattctatcatattatccaatgcaattttaaagatattttattatattatgcaatgcaatcttaaaaatattatatcctattttttaatgcaataataaaaaatattttatcctatttttgaatgcaatcttaaacatttacaatatcacaccttttttttattgtcaaattatttttttaatttttaatatatatatatatataataaaatttaaattattattacgggttcatggatcgggtcatcgggtcaatggatctgtaaatctaaacccgtaattcaacctgaatatgaacgattttgatcgattcgatttgatttttatccaaatatataaataactcaacccaaattattcggatcggttcggatcagttcaggttaacggatgatagatacccgtgaacacctctagtccaaatgaaatgggacctcctcctgaatccaacatccatttaataaataaaaagacaaggaagctaaacaagggacagctcgccttgtcttttttgtgaatagcaattcttaccttgaagcataagaactaattcttctcggcaaaagaacccaaatattacatttttaataaaaaattacaaatttggggctgtttctaaactaattaccaacttggggcaataggtcacgcccaaaattgggcgtgccagtcacgcctggtgctgggcgtgactaaattcgtcgctaaatccgtcgctaaatcggttagcgaccgatttagcaacggaatatttgttttttaatttttttgtttgcgaccaaaatattccgtcgtaaaaactgttagcgaccaaaataaaaatcaaaattggcgttttttaatttttgacgtaaaatatcatttaatattatttatttttatttaatttgaaagtatttttagactgatcttcatcatagatatgatcttttttacttttttttaatattgttttatttagtattttttttaaattttatatgattttatttaatatattctggatttttggtatatataatttttaatatattattttatttaatataatttataaatttttatatgattttgtttaatattttttggattttgtatatataactactttttaatataatattttatttaataattttattttggaatttgaaaaaattaaaattttttattttttgatacttctcattttttctaaatttttgtaaataaatttttaatatagaaagcattttaaatagaatattatattttgatacttctcattttttatatcgagactaccccatggtgaatgatcaattctttgcatttcaatttgatttactttgtctcgcacagttccactcctatttctagagttctgcaatgtttcaccgctccaagtgcgctttggaattaatggggtgctacaattctgattattgtgtggtgagtgcactttgggatgagtggaacgagtggtaaagtgtagaatgagtgtgaaaaagttaggaatgaatgtgctttgggataaatggggttattatacaaaaaatccaaaaaatattaaacaaaaccatttaaaaatttagaatatcgaaaaaagttacgacggtgtacgatatgtccttcaaatggtctaacttttgatagaaatatccgatcgaggtgtacgatatatcgaaatgctcgaaattaatagaagtaattaaaaaaataaaaaatagcatgcaattaactgactaaataattaaaaaagtagaaaataataaaatttttagatgaaatcgtaattttgaggcacttagaggccttttttgggaaaaaattttgtccaagttccctttgggtacttgccaaaggcttctcctctcaattttgagcgcgtgaccaccggtttcgtcttaatcggacattccagtcaaaagttatgaccgtccgaaatttatatacgtatcgctccatctgtgcatgacagatgtcaagagtaggtcacgtccagaattggacgtaactggtcacgtccaacaccagacgtaactgccccctagtcacacctagtgctgggcgtgactagtctggacgtgactaactgccacaaattagtaaatagttttgaaacaatcctaaatacataattttttatttaaattatattatttgggttcttttactaattcttctcacatcctctaccagactatgaaataggcttcttcttatacctaatattaaaaaaagaagaaaaagaaatatgtttcttccacgcctgacaaagctgaaaacaattcatttcatatcgagctcctattatgcataactctgccactttaatttttgcccatataaatgcaaaacgcattatctccctagggcacaattcttactgtgttatgataaatgttgaatcattgctttcttgttttggtgtacggtgaagagaaaagaataataaaaataatggatgtaataaatgttataatgaaaaataaagggagaaagataaggacaaaaaaaccatagaatagaattaggataaaaaatgaggaaaaagttaaaataatactattttttaaaaaattacaaatttaaatttgttttgaaactatttataaatatgagactatcaaacacgttaaattagacgtgactaaacacgtctaatttaaacgtgacacatgaagtaacacgtccaaattagacgtatttaattatgcacaatttgaatatgtttgacaatctcatgtttatatagttttaaaatagttttaaatttgtaattttttttaaaataatattattttaatttttttccccgaaaaagaaaagaataaaagaataaaaacaaagtaaatatatgttacccattttccaatataagcagaggcacagtctggactacagccagcccagaacagaacaacagttgaagatacatgatgtcactctccatcttcaaacttgttttgacatcatttcttctctgctttttcttgcaggagcctaccaatgctcttagaaaggcaagtaagctttgcattttattagttccctgattgttttctcgtcaatcttatggagttttgtaactgttcaagttccaactttgagaatttccctgattttatattttgttggattctgtgtttccagacctacattgtgtacatgggaggacattctcatggtccagaccctttgcctagtgatcttgaaacagccacaaattcccatcatgatttactcgcttcttacttaggaaggtaaaacaaatgttaatttctattaaatattattaggacgtacgtgttaattaaaaattgataatttaacagtcatgagaaggccaaggaagcaatgatgtactcgtacaataagcacatcaatggctttgctgccctacttgaagaggaagaagcatcacagattgcaagtgagcaaagactattactattaccattaccatgaccatgattttgtactcatcttgaagcctcacaaattgatataatgtaatatatgtttgtattggttcagaaaacccaaatgtagtttctgttttcttgagcaaagaacacaaattgcatacaaccaggtcatgggaatttcttggactggaaaaaaatggaagaactcctgcaaactctgcttggaggaaagcaagatttggagaaaatataatcatcgctaatatcgatacaggtatgcatattgcttagttttttttttttcttttttagtagatgcataatgctttagttaaaattaacatttattagagattatgaaattataaatgttttttatattgttattcaattataaggtattatgtatgctaagtttttttttttggtacaatatgaaaaatgtatgataagtttgttattttttataaaaaagatactttaaaagttattcaaacaataatttttaattaattagatgtatactataattatgcataaaatttaaactaaaaacgaaacgtattcctttaaagcgtcactgtcattttgttttctcttctctttgactagctgttattatttttttgcttatatgtatttatttattaaaatatagataaatttatttttagtctttataaatttttaaaataatggaaattattactttattgcgatatgctatatttagttacatcattttgatagttattgtaaagtaacatgtgctatgacttgctgatatatatatatatatatatatatatataattaaacagtagtattttaaaaaaagtttacaaagaataaattaataaaataattactcataacagataaaaattatatttaactatatttatagaaattcaaaaatgttttattctattttttagaaaatgctaagaaaagacaaacaagtatttgaggattttatataaaaaatcattaatttgtactccaaagtccaaacatgtattcctcttgcaatatattagtagtagctttttgaacaggagtttggcccgaacactccagtttccgagacaaaggatacggacctgtcccatcaaagtggcgtggaaacggtgtctgtcaaattgacagttttaatggcaccaaggagtacttctgtaacaggtcaattttctttcttctttcaactttcaattcgtaaattggggttacccataaacacataagaaacgagcctttttaaacaaaggtaatattctttttactgaaatatataacttaaggtaattaaatgtgaatttataaaattaatactcaagttagtgtagaaaaacaaaaccaaaacgatcaaatcaggctgcacgtacgttatcattttatacagagaaattaacaattattgaatgtgcagtcatagcgcaaatatttttattttatatatttttttcaatataagtttagcaaagggagggactgtgatgccaggtatgaagccataaatttgtcacttcggaaacaaaggatattcaacaaacagaaaaggacgggacttgaacctgacccatccctcttcagatttttcttttgcaattagtttttggattcgtcctgataactatatatagagatggaagattttcttaataagacacaaaaatacatagcagaattcaaaattttgcatacattactttgagtttatttgtttcacggagtaaaaatatattcttggaaatattaacatggaaatttaacatggtaactgaattagaccattttatttatctgtctttctattctcatgcaaatgtgagaagctttattttctaaaatattttttcacttttctcttattctattttgtttattcaatatttttattttaaattaatataaatttaaaaatattccaagtaatgttaaatatttatcgaacatcttaatatttcttgtaatagtatttctaagaatattatttcttctgtaaaaaaaaaggaatattattcctggaaacaaatgggattttcttttgtaaattgagttgaggtaatgtaatgtatatgagggtgtccatgtatatttttcaaaaattaaagaggttggtgtaggataagatcgataaaagtatgatatgatggatttgtgtaatttcaaaaaactttagaaatagttatcttaatttactttaaatcatattatccatccaaagatagaggagaaataagatgctagaatctagctagacctagtcatcatgataagttgttaacgtgatatttactggatatgctaaatttatacgcttgtaaacaaaagatgtaaatatcatgtaacatttttttaatgaagaatagtgatatttggacatcaataatttattaataagtcatttggacactaataacttacaaagactcatatttttttctcttaatccttaactttgattcatcatgaaaaatggacgttgtgtaatacagaatatctgaaaataaataaaatcttataaaaaattattttcgtcaataattaaactcgatattactcaaatgatttaattttaactttaatatattaattattaattattagtgctcaatttcttaattttacaaatactcaaaatgtgtttttttatcacatcatatcatcaatcttatcaattatttatctctccttttctatctctcttaagatgtctatatcctttaggtgtgcaataatcatttctctttgacaaaatcgggtaggaatatcttatatataggcctttgtttaggagcatatttgatatggatatttatatagggtaatttaggcgtaactttttctttgccacaaacatatgctgcatatgtttaggacttaggagcaacatcgcaagcttcatgatgaatattggccagtgtatatatctgcactgattgatcctttgaatgacagaacaaattcgataccttttaatattcttacataaattgtgctggcaagctaataagaatacctgttgtctagaagaaaaaaaaagctaataataattttttaaaaaactaatttgttttcataattagtatgttagatacttgtaatgatttagttcagtttatcattggaaattttgttgtaagtaacaaggtagaaaggcctataatattatgaatatatatattcaggaagctgattggagcaagaacgttcctcaaaaatcacgagtctgaagttgggaaggttggtcgaacgctacgcagcggacgtgacttcgtagggcatggcacccacacactgtcaacagctggtggtaattttgctcgtggtgcaaatgttgaaggtaacggcaatggtactgctaagggaggctccccaagagcacgcgttgtggcctacaaagcgtgctggcataaactggacacaggagggtgccatgaagcagatattctacaagcatttgattatgccatatatgatggtgttgatgtcatctctgcctctctcggttcgtctaatccctataccgaagctttgttaacagatgggatgtccataggggcattccatgcagttgccagaaacatagtcgttgtttgctctgctgggaatgatggaccatcacctttaagtgtcacaaatgttgcaccctggtccttcaccgttgctgctagcacaatagacagggattttctcagcgacatttctctcagcaacaatcaatccattacagtatcatctttttatacttttccttaatttattagtttcatatgtttttattatgtaacttaattaattggaatgtgtgtgtatgtatcagggtgccagtcttaatcgaggcttgccaccatcgtcaccgtcgaacaagttctatcccataattaattctgttgcggctagacttcctcatgtgtctattaatgatgcgtaagcacaatttttgtttttatttcccaagcttgcttcaaatatttatatgtacttgtctcataggtgtatatgtatgtatatatgtatgtttgttggtgtagtcgtctttgcaaaccgggaacacttgatcctagaaaagtaaggggaaagatactagtatgccttcgaggtgataaattaacttcagttagtgagggtcaacagggtgctcttgccggtgctgtggcagtttttgtgcaaaatgatgagcaaagtggaaatttacttctggccgagaatcatgttttacctgctgcaagtatcagtggaacaaataatgaaagtcaaggaggtgctttcaacatcagcagcaagtaaagttcatatatatatatatatatatatatatatatatatatcactagtccctttcaaatgtcgtgtgtgtgtgtgtatatatataaacacttaattaatttctacatatatatatattgctgcaggggggtgttagcttacttgagtgcggcaagaacatatataggagtaaagccagctccaataatagctggattctcatccaggggtcccagttccgtgcaaccattgatactaaaggtctataatatatacattttgttacaccaacatgacatgatgattttccttcttacaattgatgactcgtgtgagataaacttgctgtaatttgtttctttttcagccagacataactgcgcctggtgtgaacgtaattgcagcttttacagaaggagcaggtccgtctaatatcgcatcagatagacgtcggtctcctttcaatgtgcaacagggaacttctatgtcttgccctcatgtcgctggcattgcaggtcttctcaaaacatatcaccctacttggagtccagcagctatcaaatcagctatcatgaccacaggtacataagtaatagctatagtaatatatatgcatgcttaattacaaaatactctcgtatgttacaaaatataaaatgtacatatgcagcctatcatttggaaaagcattggtggtttattaattaacaactatgctcttaattaattccagctacaacactagataatacgaatcaaccgattcgtaatgcatttgatgaagtagcaactccattcgaatatggtgccggacacattcagcctaaccttgcaattgaccctggactcgtttacgatttactcaccaccgattacttgaacttcttatgtgcttctggttacaacaatgctttactcaagttgtttgccaatttgaaattcccttacacttgtcccaagtcttacagaattgaagatttcaactatccttcaattacggtgcgtcatcctgggtcaaagaccataagtgttactcgtacagttacaaacgttgggcctccaagcacgtatgttgtgaatactcacgggccaaaggggatcaaggttcttgttcgaccatgttcgttgacttttaagagaaccggagaaaagaagaagtttcaggttatactgcagccaattggtgcccgtcatgggttgcctttatttgggaatttgtcttggacagatggcaggcacagagtaaccagtcctgttgttgtgctgtaatgtaaccttagcagttagaagttgctctcagcattgttatgttatcactgtcatttgagtgtgtttgcgttttctgtttttaggctgtaatataagtgtgtttcctactcctgtcgtattaaactttgtctaaactaataggtaggtcatcggagctatgtttgtaatgggcacactctatcatgtatggaacctgtatctttgaaagtctaatagacattgttgagagttgagacccatatctaaataatattgaacaattttaattaggctctaatctaccaatttgccttcaccattgatttctcttctttctattttatctcgtgcagtcatgcattcatcttcagttactttggttccgaaaatagaatacctctagtctctagattagtggctgaggctgaggccaagataacctgaggcatctgcagaggaagtagctgaggccacgataacctgagcctcgggggtgcaggatccgagtaaggcaagtgaaaaatggctaccttggtgaccccaatgcaggtattcaggattttgtgcaatagtggatggaagacagggagtggtttatgtaacatctccttcctgattgttggcttttgaggaggtgcataagttgcttgtgccatgtcgggttgggtgcaaggttgaacttaatgatgttagagttaggggagctataggcattgttggttgttgtggaagaggtggtttgggaggattaacttaattatttattaacttttgaagaggttgtttctcaatgcagagatatatgtgtgtgtgtgtgtatgtggggtagtgtgtaatcatgcattgtaacatgaaattatttacgttgcctgagttagaaatggaatacatgaggtcaagcggatgatatatataaagattaacttaattattttgtattttaattttagtttcatatattttgaataagttattatcacattaaaatttattaatttttttaaaataattgaataaattatatttattaatcaatattatatttattttaatttatatttgtttttttatttttttaagtttttattataatattatacctctaatcattaataaaatagagaaaaatgaagattaaattatattttgagtaaaaagtcatttttgtttttcagttgataaattcatctttaaatatatcagatatactctttcattattaataacaaatataatttaacgaaaaaataaatttatcacattttttcacttctagaaattaaaattaaaatttttatatttaataaataaatttatagcaccctacatatttaggaaaaaaaatatttatccagtatcaagtttgagacaaagggaagaaaaacacggatactgcctctatctcgtttccaaacacacttttccttactttattctgagtttcctttatgcgctatgctaggcaactttgtttatagtgataatccacttttcttaaagtgaagaaggataatttattttaaattaatcattagcatctcaacatatcatttatattataaaatatgtcaatttttttataatttaattttttttccttttttgttcttgtaaaaaaatgatttaatccttataaaatatttcttttcttaaaaagttttaaataatatttttttgttgttcaaaacatttattttattgttcaaattacaatctaaagcatttttaaaataaaaaataaaataaacatattttaaaaggattaaaacaaaaaaaaaatatcaagacaaaaatgaaacaaactaaattataaataccaaacaagtatttaagcctatgattttttttttttataataaactgagagagacatacgtagaaaaccctgaacaagaataaagggctaaggcttgacaatgtaaggttttggaagactttttttattcatctccaatttataaagaatgggataatttctaccttttgcttgttcctttttctttcatatatttctagatctttctaactaagggttgatatgttggttcaggagtcccacatcggtgggttactccaaggaaccaagggtggagggttataaaagcataccccctccacccattttacacacaccaaaatcttcttctcttctcttataatattatttgttataatattattcttgagtataattttgtgaggattattcctagttcaagagagagataaaattgttctttccttgtgataaaaggaggttgtagtgttggagttcccatagtgaaattttttctactcttatcggtgggttttttacctcagggttttcccacgtaaaatatttgtgtccatttatcgctttcaatttcctttatctgttgttattgttctgtccgatggaatccccgctcattaacagtggtatcagagccaaggttctttcttagtatgctctgtggctgcagcttagattgatctgtcacaccagaaaagaattatccttggaagttgctgggttgatatcagtattaatttatactgaggtgctgcaggtgttatacagagactattgctgtatacagttactgttcgcaatcggagcattcctctggagaggtattttgggtgataaagtgtgtgtggaaagttttgtcacaaagacgaaacagtctaaggagattgggtattaagtgggaccacttgtgacccctccaatctttcctggaaacttttctggtgcactttccaaaatactggttgaaggagaccggagtgaagcagtgggagttactttgcagcaaaagcagttcgtgatagaaccatggcaacaaaggtagatattggcaaatttggcgggacaaagttctcgttgtggaaattgaagatgaaggcattgctgaccaaagataattgtttggaggccatcggtgctcggccagcaagatgctcagatgacgagtggaagaaaattgatagtatggctatttctgatctgcacctatctctttcagatgatatattgtcagggatagaggaaaagaaaacagccaaggagatatgggatcatctcacaaagttgtactcatcaaagtcacttcacaacaaaatatttctgaaaaggaagctctacacacttcggatgtttgaatctacttcagtgacagagcacataaatactctaacctctctatgttctcaactttcatcgttggaacatacggttgaagtatcagaacgtgctgagattctactccaaagtcttccagattcatatgaccaactcatcatcaacatcaccaataacactgaatctctagtgttcgacgatgttgctgctgcagttcttgaagaggaaagccggcgaaggagcaaagaagaaaggctggcaagttctcatcaagcggaagccttgtcaatgacaagaggacggtcaatggaatgtggttccagtgggagtcacaaacaaggaaggtcaaagtctaggagtaagaaacatgtcaagtgctacaactgtggcaagaaaggacactataaaagtgagtgtcgtttaaggagtggtggagtcaaaacctctgaagcatcaacttttcaaggatgtgttgccaatacaaatgttttatacagtgaagcagcaacggtgtctaaggatagattggagctcgctgattcatggataatggattcaggagcaacatggcatatgacttctcggagagattggtttcattcatataaaccaatttctggagggtttgtgtacatgggaaatgatcatgccttggagattgctggagttggcaccatcaaaatgaagatgtatgatggaatgatttgcacaatccaaaatgtgcggcatgtgaagggcttgaagaaaaatctattgtctttagggcaatttgatgaaaatgactgcataacccgtattcaaaacggagtgatgaaaattgtcaaaggtgcgcttgtagtaatgaaggctgaaaggattgcagcaaacttgtacaggcttatgggagagacgtatctggaggcagaagcatctgttgcatcaaccagttctgaggaagacttaacaaagatgtggcatcgcaaattgggccacatgtcagaacaagggttgaagattctagctgaaaggaaactacttcctggtctcacaaaggtatctttacccttttgtgagcattgtgttacaagtaagcaacacagattgaagtttactgcatctaattctagaagtaaaaatattctagaattaattcactctgatgtatggcaagcaccagttatgtccctgggaggagcaaagtattttgtgtcctttattgatgattattccaggagatgttgggtgtatccaatcaagaggaaggcagatgtatcttcagtcttcaagactttcaaagcgcagatagaattagagacagagaagaagattaagtgtctcaggacagacaatggtggagaatatacaggtgatgaatttaatgccttttgtaatcaggaaggcattaaaaggcaattcacggtggcatacactccgcaacagaatggagtggcagagcggatgaacagaactctactcgaaaagactagagctatgttgagaactgcaagtatggcaaagtcattctgggccgaagcagtcaacactgcctgttatgtgattaatcgctcaccgtcaactgcgattgatcttaagacaccgatggaaatgtggactggtaagccagttgattattcacacctacatacatttgggagtcctgtgttcgtgatgtacaacacccaagaagtcacaaagctggatccaaaatccagaaaatgcagattcttagggtatgctgatggagttaaggggtatcgactgtgggatcctactgcccgcagtgttgtcatcagcagagatgtactatttgcagaagataagctgcaaaagaaagatgtaagtagcactttagctaataattcagaaacattgacgattcaggtggaagatgaatctggacaacaagtctcttctgaaataacaacagaacacgaggaggaagaaccagttgagtctgaaactgcagaatttcgacggtcaactcgtgagaagaaaacaccaacttggcagactgattatgttatggagggcaatgttgcatactgtcttctaacagaagatggggagccatcaacgttccgagaagcaacagctagctcggatgcatcattgtggatgacagcaatgcaggaagaaattgaagcccttcataagaacaagacttgggagcttgtgccactaccacaaggaagaaagcccattggaaacaaatgggtttacaagatcaaacgaaacaatgatgatcaggtggagcggtatcgtgcaaggttggtggtgaaaggttatgctcagaaagaaggtatggattttaatgaaatattttcacctgtggttcgtctcactacaattcgtattgtattggctatgtgtgcaacattcaacttacatttagagcagttagatgtaaagactgcatttcttcatggagatcttgaagaagaaatttatatgctccaaccagaaggttttgaagaaccaaataaggagaacttggtttgcaggttgaacaaatctctatacggtctcaaacaggcgccgaggtgttggtataagagatttgattccttcatattaagccttaaatacaacagactcagttcagacccttgtgcttatttcaagaggtttggaaataatgattacattatcttgctgttgtatgttgatgacatgttggtgataggccccaacaatgatctgattcaagaattaaaggcacatttggctagggagtttgaaatgaaggacttgggaccagtaaacaagattctagggatgcaaattcaccgagacagaaataacaggaaaatttggctatcacagaaaaattatttgaagaagatcttgcgacgcttcaacatgcaagattgtaagccaatttctacccctattcctgttaatttcaagttatcctcaagtatgagtcctagcaatgaagcagagaggacggagatgtctcgagtaccgtatgcataagcagtagggagtttaatgtttgctatgatttgtacaagaccagacattgctcatgcagtgggagtggtcagtcgattcatggcaaatcctggtagagagcattggaatactgttaagaggatccttagatacgtcaaaggaacctcagatgttggtctatgttatggaggatctgaatatactgtcagagggtatgttgatgctgattttgcaggagatctggagaaaagaaaatctaccacgggctatgtgtttacaattgcaggaggagctgttagttggatttccaaactacagtcagtcgtggcactttctacgacagaagctgagtatatggcaatgactcaagcttgtaaagaagcaatctggttaagaaggatcatggaggagctcgggcacaaacaagaaaacattatcttgtattgtgacagtcagagtgccttgcacattgcaaggaatccagcctttcatttcaggacaaagcacataggagttcaatatcattttgttcgtgaagtggtagaagatggaagcgtggatgcgcaaaagattcatacaaaggagaatatagcagatgcgctgacaaagtcaatcaacactgacaagttcatttggtgcagatcttcatatggcctggcagagacgtagacaatatggagatggcaagagagaaagagcagtgtggagattgattgattctcaatcatatctccaagtgggagattgttggttcaggagtcccacatcggtgggttactccaaggaaccaagggtggggggttataaaagcataccccctccacccattttacacacaccaaaatcttcttctcttctcttataatattatttgttataatattattcttgagtataattttgtgaggattattcctagttcaagagagagataaaattgttctctccttgtgataaaaggaggttgtagtgttggagttcccatagtgaaattttttctactcttgtccgtgggttttttacctcagggttttcccacgtaaaatatttgtgtccatttatcgctttcaatttcctttatctgttgttattgttctgtccgattaacatgatagacccacacaactagattgtaatgtaattgaattttattcttaattcatgttaaaatttgacgtttagttattaaatatccactatcttttcttcagcaatacaattttaaatattcatgattaggctgcaagtatagtgttactagtaaatttatgaataaatatagttattttaaatagaagtatactgtatatatgaaaaaataattaataagacttaaaatttttaaagcatcaacaatgttaaaataaaaagttaaaataacaatatttatgaaatggagaaaaataatttattgttcataaaaatatatgtacataacacccacaaaaacttttaaaaaattgatgttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatatatatatatatatatatataagtgaaaaatgaaatgaatggaaataagaatatttgataagagtgatataagattttgaataaggattttgagtttaagatctagtctttattagatctttcaataaagaggtgtatagattttcaacataaataatgaattattgtaaaaaaaatcttaaaatatctgtaatattaaaaaaatcattttttttattttcttaagatctcaaaatgagttttatcactaaaaaaaatgaaacagatctttaatcctatatgaccctattaggtttactaaaaaataatttaagatctcaatttaaaatctatcactagagatgttctaaaataattaagaaatacaataaaaataaaagcatttgattttagagaaatgaaaaaacttatttatttatttattaatttcactaattattatattaaatttaagattttatttaagcaaaattaaatttattattacttaaatcaatgttatgttgatttttttgtttttatttctttgaacaagttacttttttattttctaattacgtctttctcttcctttttaacacatcagcacctcggatggactaagagagttggaggtgctttaatagatgactgttgtcctttttcgctttttacggagcctaatctttttccaacaaaagagtaaaatcttattcccccacccgaggaacaaagtggctaaaacatgcagctttttcgttacccgagtgaatatggaagagaaacttagagttagagcatattaaattattttttatttttaagaatttgtaaaataaattatttatataaaatacttagatttaaatttaaaaaatctacaatattaattgcatgttctctaactacaaaaaataagaaattattttttatcttaaaaaattcatcaaacatcttatattgaaaatcaacttaagcaaaattcctcttttttgaacggtgatgtggccatagtcaattagtcattgacttatgattatctttggaataactttatcttttccctcctaaaaacgggaaaaagaatctaaataatacaaattaaataaaaaattatacatttgaaacgattttgaaattatttataaatttgggacaatcggaatcgcccagaattgggcagcattggaaccgcccaaatccaggcggtaccaagggggtagaatcgcctggatttgggcggttccagtgctgcccaattctgggcggttccacttcgtgacttgtgtcagtcctgcacagatggagcgatgcgtatataaacttcggacggtcataacttttgactggaatgtccgattgaggcgaaatcggtggccacgcattcgaaattgagagaagaaggcgctatggtcaaaaaaatttcccaaaaaaggcttctaagtgcctcaaaattgtgatttaatcttcgaacatctcaaaattttcttgttttctaattttttaattatttagtcagttaattgcatgctattttttatttttttcattacttctatcaatttcgagcattttgacatattctacacctcgatcggacatttctatcaaaagttagactatttgaaggacatatcgtacgccgtagtaataagttaatgttcaacaaacgtttttatactaaaagataacgtgaaaatttaattacatagtaaggggataattatactaagttctctttaagttctctttggggacttgctagcgccttctcctctcaatttcgaacgcgtgaccaccggtttcgcctcaatcggacattccagtcaaaagtaatgaccgtccgaagtttatatacgcatcgctccatctgtgcaggactgacacgtgtcacgaagtggaaccacccagaattgggcagcactggaaccgcccaaatccaggcggttctacccccttggtaccgcctggatttgggtggttccagtgctgcccaattttagacggtttcgactgccccagatttgtaaatagtttcaaaaccgtcccaaatacgtaatttttttatttaatttgtattatttaggttcttttgtccctaaaaaacagagacaatacataaattggctgtgaatgtgattggagatggagaagggtcgtaggaagagaggtcaagcattaatatattctctgttgttatggtaggtagcagtggtggtggtcactaagagaaaaaagtatagtgtgtttagtaaaagaaaatgaatttgagataaaatttatttattttttaactcaaaataaaattataattaagcaaaatatataatgtatacatattttaattttgatgtaccagatttttatatggttaattaatagaattctacgtggacatgagtatagtgtgtttgaattaattttatggtgagaaatatttaatttttttagtaaaagtaaagtaaaaataccctgtaaattccaaagtaatactctttttagtcttttggttttgtatcaaaattttagttctttttactttttaatgatattatttttcacgagattttatctatgtttggtaagacttgttgaagaaattataatttttttactaatttataagttactttaaagcttatttggtacatacacaaacttatttcaagtgatttatnnnnnnnnnnnnnnnnnnnnnnnnnnnnnnnnnnnnnnnnnnnnnnnnnnnnnnnnnnnnnnnnaacttataaatttattaattttttttctcaattttatcatcaagagaataaattaatatttgcattcaaaagagacactaatcatgaaaataaatttattataaaaacaatttattatgatatttttacttttttaatttcaataaatatattattaagtagatcaagagaataatatttattaattagatgacagaattaaaattggtcaatatagaacttcttatgacctaaaacattaatcaatttggtatagaaggagtagtcgtaatcagttcttacttttatttattattgtgaataattgaaaaagtgtgagaatttattgaataatttgtgataatagtagttgaaaattgaaaatattttaatctaaatttatgtcaataaaatatttcagtgtgtttggtatgacttttggtattgtgcgttgtatgagaaaattaagaaaatgtttgaaaaaaataataaaaataatattaaatagaaattgtaaaccttttaatgaaactcatttattttatattttattttaataaaaaatcttttattgctattctgtctattctcatcttctaaataaatatatcataaaaacaattaaaattgtctgtctttcgaatctcgcactttgtgcactttaattcctttgtgcttatctttgtttttttcgacttcttttgatacctatatctttggttgattaatcaaacagggaattttctttttctttttcacttttttattaaaaagtgattggtttgaaatattttatgaaaagaaggcactttatgcaacgtttgtgctaaaattaagtgggctggagtgtttcacgtggtcgatcgagcactatttttttctcgtaaattattaatgtagttattttatttatttaattagtttaatttaatctcttctatttattattgaataaaaaaaatgttctaattagagggtgtcaacattttttattgatttcacttcctgcacctgcaaaattggcaatgccttccgctcatctctgctgtggctgttacgnnnnnnnnnnnnnnnnnnnnnnnnnnncgaaaaaaaaaaaaaagaagaagaagaagaagaagaaagaaatagaacttctaacctcttaaatgagaaagcaaacaacttagtcaaattaaatttatataaaatttatattttttcttaaccctttccgatacatcagaagaaaaatattgattaatcatgcggtcaaaaagataaataaaatctaataaaaaaaatttatgttaaatatcaaactaaaatattttagttgtttttatccaattacttggttacataatattcatatatttatatgtaatttatatcactcgttcaattcaatctatgactcaaaacgtttcatagtagaatatgataataaaaatttaataatactattattaaaattaaaattaaaattgattgcataatcaattgagtcttgttattacacatttatttccaacaaatgctaacatatgtaattgtctttgcattattaaatcaaactcaatcttcgtttgttctgtattttaacttttttttctttatttaaacagaattatatgactattatcatcaacaatggaaattacacctcaatactaaaaattcatttctaatattttctttaatttaaatagaaatagaattaaaaagtaatttttaaaataattaatatatgtgtgtatatatatcttatgcattgtatatttgatcatttaaataaaaatatgagtaaaataaaaatatttgaaacatatgaatatatttatattccaaatataatttaacaaaaactgttttaaatatagaattcatggactaatatataaacttctgcttaaaatctttacaaccggttagtcactaatatcttaaccattaaattatcaaattaatatacgataaaaagattatcaaatcaataaatctatgatgtaacttacccattgctgagaaagttattcacctccccattttagatatttctcctctttctattgtgttacaaactgatgccaatgcattgttaggcttatatagaaagatggtatttatataaaaattgaaaatatcgtaaataaatgataggaagcctagccctaatccgaataatttatgttgtcgacctgcgtcttctacagggccacaatatgttggaagagctgcaagcaggatctttatcaaaattgtcggtggtgctgttgcaatttgcaataagtaaaatatataataacagaggtaggcattgatgatgtcaatggtgtttatgtaatgaaaataggtgaaagttacgtaagatacagagctagaattaccctatgtaagagtgaatttaaaataaaattgtattttttttttctaaaagtgaattactctctttgattttttttctctcaaaccaaataagaaaaatatatatggttatacatgttttctttttctttttcttttcttttcttttatttgtgttccttccaaacggacccttatggagtcatagactctttttttgtgaatgacatatggtgattggtggaagatgacgtaggcaaatttcaaaagccaatagtaaagcattatgcgcaaagaccttcattaaattttataatatatacacattgtttgcgtcttaatttttttattacatcacattattttctatatttttcaactttatttggtagcatgatatatttaccaatcagtaagtatatataatgatttatttttcatattaaaatcatgcttatggaaaatggtgacagcggagttatattagggagcgatgatagccgtatgctctttttggtagttgcgtgtatgaatacaaaaatatagttaacatccagatcacttttaatccaacttaattgagttgataataaataaacttaatgataaatataaaaagattaaaaaaagaaaaaaataataaaaaaagaagagaaagataaaaaaaagaaaatgactaaaaatgaattatttaaaatataaagataataatagatttagttttccgtaaaacataattttccatttcatcttaagacgaatcatttgtcaatctatatatcacttcattaagtcttatttaactacatttttcatgtaagtttcggtatacatttatctctctttatatcgaagtcttggtaataaacttttattcttaagaaaggatccaagtactgtttcattacgtgtagaaaacgcctcaaaataatagagagaaaaaatagaagaagaaaaaaaaatgataaatatactaaatgatattaatagctaatgaacaatgaagagagaaagaaaagaatagaataaaattagggtaaataatcattttgtccttaaatgtatagagtgttgataaattcgttcatgaaagatgaaaattcaattttttgtcctcgaaaatgtaaaaagtgcgaaaaatttatcattccgttaacttttatctattatcgttaatgaaagaacttatgtggcacaaagagacaaaaatgtcacaaaaatgattaccaacatggctgctgactggattttggatgaaaatgtcagtaagttatcattggattaaaatgtcagtaatttttttattggacctaaatattagtaagttaccattagaccaaaatgttagtaattttcaattggaccaaaatattagtaatttttcatggatcaaaatgtcagtaatttttttggcaaaaaaggtcagtatgtttccattggaccaaaatatcatcaagttattattcgatcaaaatgtcaataatttttcattggatcaaaatatgagtaattgtttattgaaggaaaatgtcaataagtttttattagactaatttttcagatcccaaatttcatttaatttaagggcaaaatatagcgtaagaataaatcttttctctttttttatcgttacaataataataataataataataattatataaaaatcacttaaaaataaggaaacaaacataagttaaaagaaacacaataataattatattattgattaatataatcataatttgtctgtcataatataaattattttgggtaaatttggataatagattgtgactaataatcatattattccctcgtttctattgattaataaccatactctttcctatcttatttataatagattttgactaattattataatatggataaatttgtaatgattaatacattgttacaatgattatctttgatacactgatagaatatttattttagataatttacattgtgacagacaaattatgattattaatcaatgttatgattattattatgtttcttttaacttatgtttgttttcctattttataagtgattattgtattgttcttattatgtttgtaacgataaaaaaaaaaaggaaagaattaccattaagttatattttgtccttaaattaaacgaaatttggggtcttacaaattagtccaatagaaacgtattaacattttcgtccaacaaaaaattacttacattttcgtccaacaaaaaattactgacattttgatctaataaaaaattgttgacattttgatcaaatgatgacttaatgatattttggtccaaagaaaacatactgacctttttggccaaaaaaattactgacattttttgtctaatgaaaaattattatttttgtccaattaaaaattacgtatattttggtcaaataataacttactgacaattaagtccaacataaaattactgacattttagtccaatagtaacttattgacattttcatccaaaatttagtcataaatcatgttaacaaccatttttgtaacatttttatccctctgtgtcacgtagacgctgttattaacggtaatggatagaagttgacagaatgatgattttttttgcactttttatactttcggggacaaaaatttaaattttcatcttttaaagacaaatttgtcaaagtaatacacattaaaggctgaaaatgactatttactcataaaattaagatggaatatatataagcagagccacagccatggattacatccacaccaaaacaacaactaaagatatattatggcattctccatcttcaaacatgttctgtcattattccttctctgcattttcttgcaggaacctaccaatgcccttagaaaggctagtaagcttttgccttttagttcccccgttacggttatcaataaagaatctgatggagtttttccatcatctcttcaagttccaacttcgagaatttccaaatttatattttgttaattaatgtaccataaaacatctcaccaattgtgtgctttgaattctgtgttttcagacctacattgtgtacatgggaggacattctcatggtccagaccctttgccaagtgatcttgaaacagccacaaactcccatcatgatttactggcttcttacttaggaaggtaaaacaaatgttaagttctcttaaatattattaggacgtgcgtgttaattaaaatttgataatttaacagtcatgagaaggccaaggaagcaattatgtactcgtacaataagcacatcaatggctttgctgccctacttgaagatgaagaagcatcacagattgcaagtgagcaaagactattaccattaacatgaccatgattttctactcatcttgaagccacacaaattgatataataatgtattacatgtttctattggtacagaaaatccaaatgtagtttctattttcttgagcaaagagcgcaaattgttcactaccaggtcatgggattttcttggactggaaaaaaatggaaaaattcctgcaaactctgcttggaggaaagcaagatttggagagaatataatcatcgctaatattgatacaggtatgcttagttactctcttttttatcacagttcatcgtgctcttaattcagtttacattattttcttctacatgaatttgtactgcaaacatattttccttttgtaaatacgttagttgcttcttgaacaggggtttggcccgaacaccccagtttccacgacaaaggatacgggcccgtcccttcaaagtggcgtgggaaaggtgtctgtgagatcgacagttttaatggtacaaagagttatctatgtaacaggtaatttttctgttatttcatttcaaaaattgggttgagcgtgaaataatatatgtattttaaaacgttgtgattatcacggcaatggaaggtagttgttattttatttacagcttaattaatgttttatctgtataattttggctcgtatttctttagttcgtttattttaaataaattcacaattttaatttaatacttaattttgcactctttttttgattgattaaattgttttttagttgttaagtgtgcaattttcaatcctcaatgttagttaaaatgtaaaaaaaagtatgcaaaattagaattaaattaaaattgtgaattttataaaataagaaaactaatatcatgaaaaaaatagagatcaaaatactagattatgatccataggcgattaaaattataatttagttattctattatattatgtattttgtgtttattaaggatgtgtttgaaacgaaagaaaaactaccaaagtataccagctggatagaaatataggcgtaactattctactatatgtatttttttaattttatgttaattaaggatgtgtttgaagtaaaggaaagattgtgaaagtatacaagatggatatatagaaactataattttaatcaaataagaatactattttttattaaggagctcgtacacaatgactattgtggtttcatgtgaaagagtcttttttttaaataaaaaaaatgctctgccctacaaatccaaattcagacaagaacaacaataccccaatcatttttccaagagtcacaagaccaaaaataaataaatgagtatcataatagcatgcaagcaattttggagccttcagctcttctaatacacatccacaagtttaagtattttggattttttttatcataacattattattttataataatttatgatatattttttaaaaatattataaactatttattgctcacgttaaaaaaaattcttgaattcgccgctgttaattgctatcacatgtagccataatattaaagaggttggtgttggataagataaaagtatgatggatttgtgtaatttcggaaaactttataaatagttatcttaatttactttaaatcatattatccatccaaagatagaggagaaataaaatgctagaatctagctagacctagtcatgataagttgtcgttttttaagagtcatgataagttgttaacgtgatatttactgggatatgttaaatttacgcttgcaaataaaatatgtaaatatcatgcaacttttttttaataaagaatagtgatatttggacatcaataatttttttatgttatttggacaccaataacttacaaacactcattttttttttgtcttaatcttttgattcatcataaaaaatggatcttctttaatccaaaattgtctaactaaaaatcattttcaccaatacttgacctccgtacaacatgaacatttcaaccttaattattcatgctcaatcatttgattttacaaaaattgataatatctaaacaattcaattttaacttcagtatattaactattaatactcaatcacttgattttacaaacactcatattctctttctatcacatcatatcattaatcttattaattatttatctctcatctctttttatctctcgttaagatatctatatcctctatgtgtccaagaatcatttctctttaacaaaatcgggtaggaatatcttataggcctttgtttacgagcatatttgatatggatattttatatagggtaatttaggcgtgactttttctttgccacaaacatatgcatatgtttaggacttaggatcaagatcgcaagcctcatggtgaatattggccagtgtatatatctgcactgattgctcctttgaatgacagaacaaattctataccttctaacattcttacattagttgtgttggcaagctaataaagaatacctgtaatgatttagttcgatcagtttatcattggaaattttgttgtcagtaacaaggtagaacggcctataatattatgaatattcaggaagctgattggagcaagaactttcctaaaaaatcacgaggccgaagttgagaagattgacccaaggctacgcagcggacgtgacttcgtagggcatggtacccacacactgtcaacagctggtggtaattttgttggtggtgcaaatgttgaaggtaacggcaatggtactgctaagggaggctccccaagagcacgcgttgtggcctacaaagcgtgctggcataaactggacacaggagggtgccatgaagcagatattctacaagcatttgattatgccatatatgatggtgttgatgtcatctctgcctctctcggttcgtctaatccctataccgaagctttgttaacagatgggatatccataggggcattccatgcagttgccagaaacatagtcgttgtttgctctgctgggaataacgggccatcacctttaagtgtcacaaatgttgcaccctggtccttcaccgttgctgctagcacaatagacagggattttctcagcgacatttctctcagcaacaataattccattacggtatcacctttctatatttatccttaatttattagtttcatatgtttttactatgtcaacttaattaactagaatgtgtgtatatatcagggtgccagtcttaatcgaggcttgccaccatcgtcaccgtcgaacaagttctatcccataattaattctgttgcggctagacttcctcatgtgtctattaatgatgcgtaagcacaatttttgtttttatttcccaagcttgcttcaaatatttatatgtactttgtctcataggtgtatacgtatgtatatatgtatgtttgttggtgtagtcgtctttgcaaaccgggaacacttgatcctagaaaagtaagggggaagatactagtctgccttcgaggtgataaattaacttcagttagtgagggccaacagggtgctcttgctggtgctgtggcagttttagtgcaaaatgatgagcaaagtggaaatttacttctggccgagaatcatgttttacctgctgcaagtatcagtggaacccataatgaaagtcaaggaggtgcttttaacatcaacagcaagtaaagttcatatatatatatatatatatatatatatatatatatatatatatcattagtccctttcaaatgtcgtgtgtgtatatatatatatatatatatatatatatatatatataaacacttaattaatttctacatatattgttgcaggggggtgttagcttacttgagtgcggcaagaacatatataggagtaaagccagctccaatcatcgctggattctcatccaggggtcccagttccgtgcaacccttaatactaaaggtctacatacattttgttaacatgtcatgatgatcttcgttcttacaattaatgagagagataaatttgagataattggtttctttattcagcctgacataactgctcctggtgtgaacgtaattgctgctttttcacaaggagctggtccgtctgatcttgcatcagatagacgtcgatctcttttcaatgtgcaacagggaacttctatgtcttgccctcatgtcgctggcatcgcaggtcttctcaaaacatatcatcctaattggagtccagcagctatcagatctgctattatgactacaggtacgttcattaccaaagtaatatcaatataaaatcttcatgcacaccaaatcattggcggcttattaacaactatgcttttttatcaatttcagctacaacactagataacaccaatcaaccgattcggaatgcatttgataagaaagcaactcccttcgaatacggcgccggacatatccagcctaaccttgcaattcaccctggacttgtttatgatttaagcacagccgattacttgaacttcctatgtgcttctggttacaaccaagctttactcaagttgtttgccaatttgaatttcccttacagttgtcccaagtcttacagaattgaatatttcaactatccttcaattacggtgcatcatcctggctcaaaggctatcaatgttactcgtacagttacaaatgttgggcctccaagcacgtatgttgtgaatactcactggccgaaggggattaaggttcttgtgcaaccaagttcgttgacttttaagaaaactggagaaaaaaagaagtttcatgttattcttcaggccattggtgtgcctggtcacaacattcctttatttggaaatttgtcttggacggatggcaagcacagagtaactagtcctatcgtagtgctggacacttaaaaattactctcagcattgttatgttatcgatcattgtcattttaatttgtttgcttttgttgttttttaggctgtaatataagcgtgttttctgctgatgttgcattgaagtactttgtcacaaaaaataaaaggcacaatgaacaaatcaggactgcgggatgcggtgattaaaggttaagattgttgtgcctgcatgtaatttggcatatttaagattattgtttccttttccttttgtgaaaaaacagattaaactttcactatttaactacctttttctactcgatcttagcaacttgttcttttccttggtttctcataaatcaaacacggagtcatgatgatatttacttgactttggagattgacttgatccaaaaatccaagtcattggtggctataattttgtaaatttaattaataggttaagttgtaaatttaatccctaattttttaattcatgttggtttttcttgttttaatggtaatatttggttttttagttttataaattgataattttaatctccttgataaattattagtcgtgattaatagaattattaagttaattatatattaattaaaaatcattaactattaaaactttaataaataatattttattaatatttttaatgattaataatttttatttaacatataattaatttaataattctattaattacaattattagttaataatcaaccaatgaaatcataattatcaatttataaaattaagagaacaaatattataattaaaaattaaaaaagactaaaatcatgaatttaggaaattagaagggatcaaaattacaatttaatctaattaataatattgtaagcaaattattgatccttgtcattcagttttgtgaatttggtagtctatgtatgaaaggaaaaattctttgtaaattacacacatacttcccttaaagttttcatttattatattaagtattctttcagtttttcaccctacaaaaatttccctaatttaaatatttaatggctctcataacagcagctacccctcacactcaaacattcttaactctgttaacagaagcgcacacgtgactgacacacgggtttttaattatattatgtttcaagaatgtcctttatttgctactgatttccagcacatgaaattgaagcactgtccaaaaatgaccatttcattcttaaaccatttatttgatctgaagttcacttaactataaacgaaaaaattagaagataaatttcaaaaacaaattaagataggcaatgaaaaacgtgaataattttttttcacacacatctgcttcccaatccgctcaaaatggcaagtttaataccatacaaattcttcaaaactggaaatttcttctgtgaaattacaagaacaaacgaaactaacgtctcagtagtttctcaatgtattagattcttttatatatctcgcagatatagggatgtcgtataataggtccaaactttagggagagttcttgtaatttatgtttgttttaaatataaactaaacgttaaggatatagcctatgttcctttcgtgtctgctcaaattgagatggtcttagggaggtaaacattgaacatcttagactcaaaatctaaagtttctctgcttaaagatggccgagtatttttgcttcttgttgtgtccttcttacttcttcttgtatcattcttttttgaatgtcctttcttattacttggcaaaactatccttagaaaggtgaaatacttataaaacacactatgacgctcaagttaggtctagcacacaaagaataatgaatgtagtaaatgagtggatagaataatctgtattatcttgaaaacttaatcctttatatatatatatatatatatttattggccttacctcttaattgaggggggcataatatgaaattacatgatgatattaatatagtattaagataagttaagctaaatttcttaactttaatgaggtagttgagaaggtactagactatgctaaagggattccaggttgtaactgacaaagtattatgccatgcttaagggctgcataggtcacgccgaagaagacacgttagaatatcacaattcataaggaaaatatattatgtttaatcttaaatattcatatatttatttgtaaattttttaagatagattaataaaaatatatttataattaatgtcaatctaacttaaaatatattaagaatttaagatattatttaattaaattttaaaaataaaatttaattaaaatacactgtcattcatatatctatttatatataaaaatattatcatatatgacaattttttaataattaatttaaaaattatatatagaatgattttttattaatatgatattaaaagtttatattgacggtgaatgaaaattaggctcttaaaaaaatatattttttggcttaaatatatttttcatttatgtaatatactattttttatttaattctttataattttgtttttcaaaatggacattgtaaaatttcctttttagttttagtctttgttattttattttagtgattataatgcactgttttttgttttatttcttataatatttatttatcttgaaatattctctttgaaaaatatttaataagaactaaaagaaaataatatacatattacaaggaaaaataaaataaaatcaatatattatcatgaaagctgacataaatcatgaaagttaatcaattcactcatacacatttaattcacaaaaacatcaatcaacaagagtttgtgttcaatcaagaatcataaattcaatctcaatcatacgatcgattaaatcaaaacatgctcaaacagtctcatcaaaataactatctattatgcaaaattaaagaaaccgtaaattgcagaatttaaataactagagtgcaaaaatttaaagatagattcagaaaataaaataaggaacgaaaaaaagaagaataaatctagaaaaaaagaaaaagatggctttaatcctgtgtcgaccatggattccacgctccctaagtcgatctgacatttgcaatgtaatcatcatcctctcaaggctccgcaacatctatgtcaccaaatggtccattcgtagctccagagacagcactcccccacagaagaaggcttgtccctaggtcaagcaactcgcttaaggaagtcctctagagtcgtgatcggctgacgaagaaagagttgatgaaggctctgcatcaggagatattgtccgtggggaaggctggtcagcatggaaagaagtggctcctgaatacgtggtggagaggcggaccctcgttgttttctagtgaccatctttaaaggatagacaaaaatgagacaaaagaaaattaaattcacataaaaataaaatatttcacaaaaatagagaaaaaaggtaggaatgttgggttgcttttcagtaaattcttctttaacatcactagcttgactagcaaaatgccttcaaggtggcatgaaggtcacatagaacacaccttcctcttgcattttcgcttcttagctagagacttcatgaaaatcatgtatccatggaacgactttcatatcattgcaagggaagtgtttgtgatcaaggaaaacatggcacttctgaatttatcacattctccatgcctttctttcttgccaatcaattgatgaggagaggtattgacttggagatgacttttttgttgaatttctacgtgtgagcactgctcccattgttgttgtgttctctcttcacttttcttttttttattcatctttttcttgtgaatcatgctagctcttctacaagattctcctcaagtgttgtaagctctacaaaattttcttcctttgtgatcaaaaaagacattttagccacttcttttactagcttaccaacttgaatctccagattttgaattgagttttgattggctttgaatctagcttgggaagtttccatgaattgcataaacacattcccaagattatagattctttcttcttcatattgattgaaagggtataactattgttcccaccaagaatttttcatgaagtaaatatgacaattatcattgaaatgctctcttccacaaaaatcacaattgataggttgtgggtgactgatccctatgaattgcatcacagattatcaagattaacgatttttttcttcttcatattgattgtaagggtgtaactcttgctcccaccaagaatttttcatggactaaagataacaattatcattgaaatgttctcctccacaaaaatcacaattgataggttgtgggtgactaacccctatttacatgattttaagatgctcagacaacatctctgattggttaacaagaagcctttgttgtctgagcacactactccaaatatcttccatggatcatattcttcaaaggtttcagcatgtaagcatagactaaaaagaaaaagataattttttttaaaaaaaaaattttatttttaaaaataatttttgtctttaatttttttttcaaaatttgtttaccaaaagggaaaataaaataaaataaatgctgaaattctgtaagataaattagaaagatattaaatctaataagataaagataaaagataatataaaataacaacctaacaataaaatccagaaagataataattatgataattttctaataaatttaaagataaatacataatctaatccctaaaagataatataaaataaaatctaaaggatttaaattttgaaatacaaaaaaaaatcttgatgttaaaaataaaattaaatgcttaaaacaagggtatacaaactaccgagtacaagaaacaaattccccgataatggggtcaaaaactacttattcgacaaccgtaccaattcgtctaaataataataaaatgataagaccgatgtcgagtccacatggactttgattatactcaaaatttgtatagtctaattttaagcaattaacataataattttgggatttgtagtcttgcatgtgataatataagtaaatataaatttaaaataaaataaattaagaaacatattataagaaagagaacacaagcacttgaagatgtgatttgaaggttgatgtaggcttatgagatatgttgggtgttaagcctaccaaaactactcttgatgtaatgttaatgatttttcattatttaatattatttttcatattatcttcatctttaatttattctaaccatgatctctcatatgaaagaacctaaattacctaatttcactcatgatccctcaacaagctacatcaaataatttataaatcctcataacattacatgcatatgaatgaccaaaccacaaatatgataatagtttcataaaagaataataatatgaaagtaacactaaatatagatagtaataattgttacatcaagagtgtttggttgctgaaccccaacaataagtgatttagcttttcattgacatcatagacttacaaaaacaaaagagaaaaacaattgatgaaagagaatgaaaaaaattggtagaacaaggggcataaatccatttatgtagaatgaattcttctttcttttgtgcctttataaatccatttatgtagaatgaattcttctttcctttgtgtctttggtttctctatctgacttccctatgactgctcccatttttataatcaaaactttgtttaattggacttttttttatattggtgacacgctaggctggtgtgtgcccactaagtccatatcctcaatcaatctttcaagtctttaatgtgtaatcctaaaaagaaaatacaacaagtacactacaaatcaactaattttagtatttcttgaatgaaagcttataaaaagttgaatttctatattgcaatcacaaaagaaataataaaagaggaaaaagaagataattgatatataatttaaatgcacaatttccttataaatagcaattatcaatgtacctttattattagctaaacaaacgttattagaattgttccttttttttaggcaagaattgttctttttataaaccagaaaaaataataaatatataaaaatgacgttcccaaattctctacataaaaaaaaaaaaaaatcaagtacgaaatcgattagaggtcaagttccctacgtgaacagtaatggtgctagttgtataaacaatctggagagggtattatttgcgtaattattttttattttgtattatttgagtaaaaaaattaattgaatgatttcttatttattgatagtatacaaatctttatttatatgcaatagaatctttatttacataaataaatttgttaaccttttacatgaatgtttttttcctctatttatatttataaaaattaaaaaatgtctctttgtcttttttaaaagaataataaacataaaaacgttcaacagttttaagtataattataatttacaagtggggaccacaattttttttggatttggatgcattaactttacacagtagtaaaagtcactatcactttgactattagattaatcttatcatccaaatttcattacttgttttaaaagatattttttgatttattttttactttagttattaatttatcactttttactttaaacctataaaaaaatacaactaagtgtgtagattaattgttacgaggtatttcaatttagcacatggttgaggagaaattttatcgccaataaactataaggatcctatctacttcaagcatgattacatttgatgaaacataccagtggtctggataaaaaaaagtcagaaattttgtagcatgctgctagaaatttctttaattttctaaatgatataagagagtatggattaaactgaaataattttgtactagttagtagttaatctataccctcaacaatatttttatggttttaaaatatacaagatataaaaactaaattaataatcaaattaaaaacatctttcaaaacaaaatcgtaaaatttaaactatcaaattaatctaatattttaaaataagatcaaggatatgtttggatataagtttctctataaatatttttagaaaaagaaaataagaagaaaaaataaaatgaatttttttataaattaaaatatatttttcattaactaatttatagatatcatatcattctttaaaaaagttatattgatgagcttctaaaaattaattaattaagaacttatttaaatttacggaaaaatttatatcattatttatacttacccaaacatgtctttaagtaattgtaaaatgcccaataaatccattccatgttttctgaggctacacttggtacgtaatttcacattaaataggagcagtttttctgctatttcattacactatcatctactagctctgatcgaggatccatcatcttctgctattccataatcacccaataactcaaatatgatgttctctaagctttcattaattcatctaattctctgttcactcttaagcctccattcctcccaacttttcaagtttacttcttttgcctttgctgccatcactgctgaaaaccatgannnnnnnnnnaaaaaaaaaaattaaaataggctaaatcagatgcaatattattattttttttgtgaaaaacaggagaaaaccccaagaacactaaaatccgcaagaaaacacggtcttacaactttcagccaaaacggtattatacaaaaaaggaagggacaaaatcaaagaccttaactgcctaatcaaaccagaagcaatttgcgattacagctcaaagaagagtcggacttatacacgtccctgttccaaaataaacaagatcatattattgcctgagctagaaataatgggtagatgaagattgaaggggttaagagtttcatccttaggatagtggtgcaactttggtgactttcaattgtggatttgcattatgggaattgtgacagaagcctttctttttttttttttaataaacaccttcgttaatcattatagaactctgtttgataaagtttgacatttggagaacatctctcttaatttttaggctttgaagaatttcataataattttaaaattctttaaattcttttccttaaaaattaaaactcttaaacaaggagatgtcaccatctaaatcttttccttcattcccatctcctttaaaatctctttttcaaacaaagtgttaaggtttactatgaatttatccgctaatataaagaacctcttattacaaataatgtacacactatttccaaaattcttcaagatacatagtgatgtcacacgggaaggattcaagtcttataatatatatatatatatatatatatatatatatatatatatatatatatatannnnnnnnnngggatgcggtgattaaaggttaagattgttgtgcctgcatgtaatttggcatatttaagattattgtttccttttccttttgtgaaaaaacagattaaactttcactatttaactacctttttctactcgatcttagcaacttgttcttttccttggtttctcataaatcaaacacggagtcatgatgatatttacttgactttggagattgacttgatccaaaaatccaagtcattggtggctataattttgtaaatttaattaataggttaagttgtaaatttaatccctaattttttaattcatgttggtttttcttgttttaatggtaatatttggttttttagttttataaattgataattttaatctccttgataaattattagtcgtgattaatagaattattaagttaattatatattaattaaaaatcattaactattaaaactttaataaataatattttattaatatttttaatgattaataatttttatttaacatataattaatttaataattctattaattacaattattagttaataatcaaccaatgaaatcataattatcaatttataaaattaagagaacaaatattataattaaaaattaaaaaagactaaaatcatgaatttaggaaattagaagggatcaaaattacaatttaatctaattaataatattgtaagcaaattattgatccttgtcattcagttttgtgaatttggtagtctatgtatgaaaggaaaaattctttgtaaattacacacatacttcccttaaagttttcatttattatattaagtattctttcagtttttcaccctacaaaaatttccctaatttaaatatttaatggctctcataacagcagctacccctcacactcaaacattcttaactctgttaacagaagcgcacacgtgactgacacacgggtttttaattatattatgtttcaagaatgtcctttatttgctactgatttccagcacatgaaattgaagcactgtccaaaaatgaccatttcattcttaaaccatttatttgatctgaagttcacttaactataaacgaaaaaattagaagataaatttcaaaaacaaattaagataggcaatgaaaaacgtgaataattttttttcacacacatctgcttcccaatccgctcaaaatggcaagtttaataccatacaaattcttcaaaactggaaatttcttctgtgaaattacaagaacaaacgaaactaacgtctcagtagtttctcaatgtattagattcttttatatatctcgcagatatagggatgtcgtataataggtccaaactttagggagagttcttgtaatttatgtttgttttaaatataaactaaacgttaaggatatagcctatgttcctttcgtgtctgctcaaattgagatggtcttagggaggtaaacattgaacatcttagactcaaaatctaaagtttctctgcttaaagatggccgagtatttttgcttcttgttgtgtccttcttacttcttcttgtatcattcttttttgaatgtcctttcttattacttggcaaaactatccttagaaaggtgaaatacttataaaacacactatgacgctcaagttaggtctagcacacaaagaataatgaatgtagtaaatgagtggatagaataatctgtattatcttgaaaacttaatcctttatatatatatatatatatatttattggccttacctcttaattgaggggggcataatatgaaattacatgatgatattaatatagtattaagataagttaagctaaatttcttaactttaatgaggtagttgagaaggtactagactatgctaaagggattccaggttgtaactgacaaagtattatgccatgcttaagggctgcataggtcacgccgaagaagacacgttagaatatcacaattcataaggaaaatatattatgtttaatcttaaatattcatatatttatttgtaaattttttaagatagattaataaaaatatatttataattaatgtcaatctaacttaaaatatattaagaatttaagatattatttaattaaattttaaaaataaaatttaattaaaatacactgtcattcatatatctatttatatataaaaatattatcatatatgacaattttttaataattaatttaaaaattatatatagaatgattttttattaatatgatattaaaagtttatattgacggtgaatgaaaattaggctcttaaaaaaatatattttttggcttaaatatatttttcatttatgtaatatactattttttatttaattctttataattttgtttttcaaaatggacattgtaaaatttcctttttagttttagtctttgttattttattttagtgattataatgcactgttttttgttttatttcttataatatttatttatcttgaaatattctctttgaaaaatatttaataagaactaaaagaaaataatatacatattacaaggaaaaataaaataaaatcaatatattatcatgaaagctgacataaatcatgaaagttaatcaattcactcatacacatttaattcacaaaaacatcaatcaacaagagtttgtgttcaatcaagaatcataaattcaatctcaatcatacgatcgattaaatcaaaacatgctcaaacagtctcatcaaaataactatctattatgcaaaattaaagaaaccgtaaattgcagaatttaaataactagagtgcaaaaatttaaagatagattcagaaaataaaataaggaacgaaaaaaagaagaataaatctagaaaaaaagaaaaagatggctttaatcctgtgtcgaccatggattccacgctccctaagtcgatctgacatttgcaatgtaatcatcatcctctcaaggctccgcaacatctatgtcaccaaatggtccattcgtagctccagagacagcactcccccacagaagaaggcttgtccctaggtcaagcaactcgcttaaggaagtcctctagagtcgtgatcggctgacgaagaaagagttgatgaaggctctgcatcaggagatattgtccgtggggaaggctggtcagcatggaaagaagtggctcctgaatacgtggtggagaggcggaccctcgttgttttctagtgaccatctttaaaggatagacaaaaatgagacaaaagaaaattaaattcacataaaaataaaatatttcacaaaaatagagaaaaaaggtaggaatgttgggttgcttttcagtaaattcttctttaacatcactagcttgactagcaaaatgccttcaaggtggcatgaaggtcacatagaacacaccttcctcttgcattttcgcttcttagctagagacttcatgaaaatcatgtatccatggaacgactttcatatcattgcaagggaagtgtttgtgatcaaggaaaacatggcacttctgaatttatcacattctccatgcctttctttcttgccaatcaattgatgaggagaggtattgacttggagatgacttttttgttgaatttctacgtgtgagcactgctcccattgttgttgtgttctctcttcacttttcttttttttattcatctttttcttgtgaatcatgctagctcttctacaagattctcctcaagtgttgtaagctctacaaaattttcttcctttgtgatcaaaaaagacattttagccacttcttttactagcttaccaacttgaatctccagattttgaattgagttttgattggctttgaatctagcttgggaagtttccatgaattgcataaacacattcccaagattatagattctttcttcttcatattgattgaaagggtataactattgttcccaccaagaatttttcatgaagtaaatatgacaattatcattgaaatgctctcttccacaaaaatcacaattgataggttgtgggtgactgatccctatgaattgcatcacagattatcaagattaacgatttttttcttcttcatattgattgtaagggtgtaactcttgctcccaccaagaatttttcatggactaaagataacaattatcattgaaatgttctcctccacaaaaatcacaattgataggttgtgggtgactaacccctatttacatgattttaagatgctcagacaacatctctgattggttaacaagaagcctttgttgtctgagcacactactccaaatatcttccatggatcatattcttcaaaggtttcagcatgtaagcatagactaaaaagaaaaagataattttttttaaaaaaaaaattttatttttaaaaataatttttgtctttaatttttttttcaaaatttgtttaccaaaagggaaaataaaataaaataaatgctgaaattctgtaagataaattagaaagatattaaatctaataagataaagataaaagataatataaaataacaacctaacaataaaatccagaaagataataattatgataattttctaataaatttaaagataaatacataatctaatccctaaaagataatataaaataaaatctaaaggatttaaattttgaaatacaaaaaaaaatcttgatgttaaaaataaaattaaatgcttaaaacaagggtatacaaactaccgagtacaagaaacaaattccccgataatggggtcaaaaactacttattcgacaaccgtaccaattcgtctaaataataataaaatgataagaccgatgtcgagtccacatggactttgattatactcaaaatttgtatagtctaattttaagcaattaacataataattttgggatttgtagtcttgcatgtgataatataagtaaatataaatttaaaataaaataaattaagaaacatattataagaaagagaacacaagcacttgaagatgtgatttgaaggttgatgtaggcttatgagatatgttgggtgttaagcctaccaaaactactcttgatgtaatgttaatgatttttcattatttaatattatttttcatattatcttcatctttaatttattctaaccatgatctctcatatgaaagaacctaaattacctaatttcactcatgatccctcaacaagctacatcaaataatttataaatcctcataacattacatgcatatgaatgaccaaaccacaaatatgataatagtttcataaaagaataataatatgaaagtaacactaaatatagatagtaataattgttacatcaagagtgtttggttgctgaaccccaacaataagtgatttagcttttcattgacatcatagacttacaaaaacaaaagagaaaaacaattgatgaaagagaatgaaaaaaattggtagaacaaggggcataaatccatttatgtagaatgaattcttctttcttttgtgcctttataaatccatttatgtagaatgaattcttctttcctttgtgtctttggtttctctatctgacttccctatgactgctcccatttttataatcaaaactttgtttaattggacttttttttatattggtgacacgctaggctggtgtgtgcccactaagtccatatcctcaatcaatctttcaagtctttaatgtgtaatcctaaaaagaaaatacaacaagtacactacaaatcaactaattttagtatttcttgaatgaaagcttataaaaagttgaatttctatattgcaatcacaaaagaaataataaaagaggaaaaagaagataattgatatataatttaaatgcacaatttccttataaatagcaattatcaatgtacctttattattagctaaacaaacgttattagaattgttccttttttttaggcaagaattgttctttttataaaccagaaaaaataataaatatataaaaatgacgttcccaaattctctacataaaaaaaaaaaaaaatcaagtacgaaatcgattagaggtcaagttccctacgtgaacagtaatggtgctagttgtataaacaatctggagagggtattatttgcgtaattattttttattttgtattatttgagtaaaaaaattaattgaatgatttcttatttattgatagtatacaaatctttatttatatgcaatagaatctttatttacataaataaatttgttaaccttttacatgaatgtttttttcctctatttatatttataaaaattaaaaaatgtctctttgtcttttttaaaagaataataaacataaaaacgttcaacagttttaagtataattataatttacaagtggggaccacaattttttttggatttggatgcattaactttacacagtagtaaaagtcactatcactttgactattagattaatcttatcatccaaatttcattacttgttttaaaagatattttttgatttattttttactttagttattaatttatcactttttactttaaacctataaaaaaatacaactaagtgtgtagattaattgttacgaggtatttcaatttagcacatggttgaggagaaattttatcgccaataaactataaggatcctatctacttcaagcatgattacatttgatgaaacataccagtggtctggataaaaaaaagtcagaaattttgtagcatgctgctagaaatttctttaattttctaaatgatataagagagtatggattaaactgaaataattttgtactagttagtagttaatctataccctcaacaatatttttatggttttaaaatatacaagatataaaaactaaattaataatcaaattaaaaacatctttcaaaacaaaatcgtaaaatttaaactatcaaattaatctaatattttaaaataagatcaaggatatgtttggatataagtttctctataaatatttttagaaaaagaaaataagaagaaaaaataaaatgaatttttttataaattaaaatatatttttcattaactaatttatagatatcatatcattctttaaaaaagttatattgatgagcttctaaaaattaattaattaagaacttatttaaatttacggaaaaatttatatcattatttatacttacccaaacatgtctttaagtaattgtaaaatgcccaataaatccattccatgttttctgaggctacacttggtacgtaatttcacattaaataggagcagtttttctgctatttcattacactatcatctactagctctgatcgaggatccatcatcttctgctattccataatcacccaataactcaaatatgatgttctctaagctttcattaattcatctaattctctgttcactcttaagcctccattcctcccaacttttcaagtttacttcttttgcctttgctgccatcactgctgaaaaccatgagagggaagcagctgctctacttgagtggagagtgagtcttgacaaccaaagccaagcttctttgtcatcatggtccagtgctgtaagtccttgcacgtggaaaggaatcgtttgtgacgaatccaactctgtaaccgctataaatgtggcaaatcttgggctaaaaggtactcttcacagtctcaaattttcatcttttcccaagctgctaactctggatattagtaacaacagttttaatggaatcattcctcagcaaatttctaacttgtctagagtttctcagttgaaaatggatgctaatctttttagtggttcgatccccatttccatgatgaagttggctagcttgtctttgctagacttaacaggcaataaactttctggtaccattccatcaattagaaacttgacaaatttagaacaccttaagctcgcaaacaatagtctctctggtctcatcccaccctacataggagagttggtgaatttgaaagttcttgattttgaaagtaatagaatttcaggatcaattccttcaaatattggaaacttgacaaagctcggcatggtattcttagccgataacatgatctctggatccgttcccacctcctttggaaacttgatcaatctagagtcgctggacctgtctacgaatactgtttccggagttattccttctacccttggaaatttgacaaagctcaattttttaatagtgtttaagaacaaacttcatggtacattaccaccagcactgaataactttaccaaactccaaagcttacaactatctacaaatcgtttcaccggtcctttgccacaacaaatttgcatagatgggtcactgagaaaatttgctgctaatggtaattctttcaccggtccagttccaaaaagcctgaaaaattgctccagtcttaccagagtaaacctatcaggaaatcgcttgagcggaaatatctcagatgcttttggtgtgtatccagagttatacttcgttgagctgagtagcaataatttttatggccacatttcacccgactgggcaaagtgtcctagtctcacaagccttaggatatccaacaacaatttatctggtggtatacccccagaactcggccaggcacccagcttacaagtactagtcttgtcttcaaatcatctaacaggaaaaattccaaaacaacttgggaacttgacctctttgtttgatctatcactaggcgacaatgaactttttggcaacattcctactgaaataggtgctttgtcccgcctcaaaaatttggtgcttgcagcaaataatttaggtggcccaattccaaaacaggtgggatctttactcaaattagttcacttgaacttgagcaacaacaaattcacagaaagcattccttcgtttaaccaattgcaatctcttcaagatcttgaccttagtaggaatttgttcaatggaaaagtaccagcagaacttgcaactttgcaaagattggaaactctaaacctctcacacaacaatctctctggagccattcctgattttaagaatagcttggcaaatgttgacatatctaacaaccaattggagggttcaattcctaacattcccgcctttcttaatgcttcatttgatgcattgaaaaataataaaggcttgtgtggaaatgcctccggtttggtgccttgccaccccctacctcatgataaaatgaaaagaaatatcatcatgttgccattactcctttctttcggcgctctatttctattattattggttgttggaatttcgttttgtatttgctaccgaagagcaacaaaagccaaaaaggagaaggataaagaagatcaaaccaaggatcattattccctttggagttatgatggaaaattagtgtatgaagatatcattgaagccacaaaggggtttgatgacaaatatctcattggagaaggggaaactgcatctgtctatgaggcaaaattaccctcgggacagattgttgctgtgaaaaaacttcatgctgcacccaaagaggaaacaccagattcaaaagctttttcaactgaggttaaagccttggccgaaatcaagcaccgtaacattgtgaagtcacttggatattgtttacatccacgcttctcctttttggtttatgagttcatagagggtggtagcttggataaagtactaaccgatgatacgcgtgcaacaatgtttgattgggaaaggagggtgaaggttgttaaaggtgtggcaagtgctttgtaccatatgcatcatggttgctttcatcctattgttcaccgtgacatatcaagcaagaatgttcttatagatttggattatgaagcccgcatctctgacttcggaacagctaaaattctgaatcctgattcacaaaatttaacagcgtttgcaggcacatatggatattctgcaccaggttaggccatttttgttcttaagaatttaatcctatatatattattgtttcaataataagtcctgctacttgctttataatactatttttattattttgatgaattacagagcttgcttatacaatggaagtgaatgagaaatgtgatgtcttcagtttcggagtgctttgtttggaaataataatgggacagcatccaggagatatcatttcttcattgttttcatcatctgcgtctaatatgctattaattcatgtgttggaccagcgactacctcagccagtgaagccaattgttgaagaagtgatcttgattgcaaaattaacatttgcttgcttaagtgagaatccacgctttcgcccaagtatggaacaagtgcataacgagtttgtgatgccaaaatcatcttctatggatccactccccatgatcacacttggtcaactatctaaataattgaaacttgttttctggtgtgttgtatgttttttagttttttggtttacacggtaattaagcttttcgtgatattaatgttattctcttgcatgttttgtatgtttctgatggagtgctttgtatgtttcttctgttctgtgaagacttggaaaataatggaaagttgcctatgtcttttgtaagatcgaataaataaagtgtgatttttgaagggagacagtcatgtttttggtctttataaaataaataaagttgctttacataaaaataaataaaaaagctactttatgaaaagaaaaaagtaatgtttttggtaagataaggatattttgactgtatatttctttgagagttatttggcgttaatggttagccactcgatgaagtatattgaatttaattgaagacactcccaagtcccattatatattaggactttagtaatctacaagaaaactcgtataaggatattttgaagaataaatttgaatataaatgttatatatttcacacaaaactattatacggatcattttattttatttttcaaataaaaaaaattaagattatttatgactgatatctgcaacaaagtttaatcaattaaacattttattaaatcaaatatcaattgattaaaatatttatttttataaataatgttctattatgaattttgataaataaatgttatatgaaattttcataaaatgagaaattaattaaattaaattaagtagtttgattggttcaaaattaaaagctttattcattattataaaatataagaaactaatatatttaagagattaaaaacatatttaagattaatatgtttgtaaaaataagaaagacaataaaaatattttagtaaaatagatttctaataaatattatgatattggagttattatttttattagcttatgtgaaaaaaatcttatccctaccccagtatacatgtcatgtcgatatctcgcggttgttacaaaaggaagtcgttcctctccaaaaaaaaagaaaaaaaaaaaaaaaaaaaaaaaaaaaaaaagaagaagaaggaagtcgtttctttgggtccaccaaaagaacgaatgaagttgtctttcgataaatcaatctgagtttttgtgccttattcaaccaatcaatctaagaaaaatataactccatttgtaaatttctttagcttaaacatgcctgatgcacatttttaaaaatgtgagttttgatttaactaaatcttacccaaccaatttttaaaataagattattctttatttatatattttatattttgtatcatttctaatcaatgtgatacttttttttttctcaacaattacaaatatatatattaattacacaaaaagtgaaatttaggtttatatgtcttcttaaaatatttttagatttgatgtgtgattaaaataaagtatcatattattctaaaatatgtgtttaaatttaaccaaatcatataaattaacttgtaaaatgaaaattatcatcccttatatatttatcttgatattatttttatctattatatggcttaattttgttcaatattatatgaggcttcattcttgtttattctatatctaatttcattttatttatttagttccaaagcaaagtggtctgattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttactttcactttttattttttattcactttaaaaaaggcaaaaaaaaaaaagaaaaaggaatggccaattaagctaatacgattcacacgatgatgttcttaaatttctactaaaactagtaaagtgacccatctgacaaatttgaattttgaaaataaatatatctatattatatataaagttgatgatgcacatcttactaaagagtaaaatgnnnnnnnnnnnnnnnnnnnnnnnnnnnnnnnnnnnnnnnnnnnnnnnnnnnnnnnnnnnnnnnnnnnnnnnnnnnagtaatgttcaacataatcattatattttaaaataataataataaaacttaatatatacattaattaataatttcaacttaattataaatttaaatgtaatttatgagaaattctaaataataaaataatttcattactaatatgtttttatagttacaataaaaaaaattagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggaaataaatgttatagaaatgtaggtaaattataaataaataaatttagacaaaaaaatatttttgattcttctaacatattgttttttttgtttaaatattttggttcttataatttatttttttaaatgacgcttgtaaaattctttttcttttttgtttttgtccttgtaattttgttatagttcttgtaaaatctatattatttgtttttagttactatcaaataacttttaaagagactaattcaaaatgcaaaataaatatatatatatatatatatattacaagaactaaagaaaaataacaaggaacaaaatcaataaaaagaaattccatagaaatcattttgaaaaaaacaattttttaactactaaaaccataaaaacaatatatataccgaactgaagagatatttaagccataaatttatatttaacttcattgactaatatgtctattcaatttcgcttaacaatcaaaccatatatattaatgcttatgagggaatcatatttgttttggaagatatgctcttcaagcacttgaaccagcttggatctagacaaaccaattacaataaaacctactaaatcacgtatgggtttagggaaatgatattttaaattataaacattatattaatatataaatattattaaatacatatttgaatattaattaataatattagtactaaatttacttcacatataatatttattaaattgaaaaaaaatacatggcctataatttcctaattatttagtgataactaataacatcaatcatgtggtgataaatgataacaccaccataactcataccaatagttataatttattatgggtctagctcaattatatttgagtaaaatttttgtaaatcttataatattagtcttcaataataaggaataaaaaaataattataatgttgattcaattttctgatagattttctactataaaacaggtaactatgtcactcttaattatgtatttgcactgaaacatatccctaaattaatctttggagggaaccttgtaatgcaagttccgaacacttgagaaatctcgagttctcgccggcgagggttttattatttgggaatattatatttcatttattatcatttttggatctattttaaataattttctaaaaggataagtcataataggtattacgacttctgaattaaaaatcataattaatattacgacttataatttttttaactgaagtcgtaaaaaaatttatgactttaatttatttttttttaaaatttacaattttaaaattgcatttttttttacttttaaaattgtaagttataaatttttttacaaacttcagttaagtattgttttaagagttacgactttgaagttatatgatttttttctaaattatgtaccttctattttatatttttacacttttaaaattagtattttatttttttgtttatcttttttaaaaaattgtaaatatctttttaatttaattatttaaaaataaaagtatttttaatatgttttatatattttctataaaaattaaaaaaatgaaaaaaatatataaaaaaaacttagtatatgaatattaattcattgaagtctataattgattcttatctgggtagcaattcacccaaaaaatcttatccgtgtagcaactgccgttaaattgtttatacggcatgtgatgcacacttttcacacgctactggagacttctttatttttcaaaaaaattatattcaaataaaagctaactggtttaggatttttcttttttaaagaaagcaatcatctttatttttttaaaaaataaatccttcataaaagctgaaaacaaaataattagctaatcaaatgcattgcttcaacatatgcttccttaattccaaacaggtaaagcactacttcgtctccgacttgaacgttattaagtaatagtagagttgttggattgaaaattaacaagtctgctcttagttctcaaccggtgaaacatgtgattattatctcaaactctcacttaaaattgaaccgtaaagcataaataggatgtttaacaaaagaataaaattgtgaacgagtaaagttagattttgatgtaacatttcaccaaattgggtcaattgtcatattctaacaagccttaaaatgtctagcaacaatttatccggtggtaaaccgccagagctcggccaggcacccaaattacaacaacttcaactctcttcaaataatattagtggaaaaagtccaaaaagttttggtaaattgaccctgttgtttgaactctctttgagtcacaatgaattttctaactacattcccacagaaatgggatctttgctaaaccttcaacatttgaaacttgcagcaaatagtctaactggtccaattccaaatcaacttggacgactgctcaagttaattaattaacttgaatttggcaataataaattatctttgtggcaacttgttaaatggacaaatactagatcacttggaaagttgcacagattggaaaatttgaatctctagcaccattccatccaattttaagaatttgttgagtttgacaaatgttgacaccaacaactaattagagggtccaattcctgataatgttgaaggtaacggactaacgactatggtactgcaaagggaggctccccaagagcacgcgtggtggcctacaaagcgtgctggcataaactggataccagagggtgccatgaagcagatattctacaagcatttgattatgccatatatgatggtgttgatttcatctctgcctctctcggttcgtctaatccctatactgaagctttgttaacagatgggatatccataggggcattccatgcagttgccagaaacatagtcgttgtttgctctgctggaaatgatggaccatcacctttaagtgtcacaaatgttgcaccctggtccttcaccgttgctgctagcacaatagacagggattttctcagcgacatttctctcagcaacaataattccattacggtatcacctttctatatttatccttaatttattagtttcatatgtttttatcatgtcaacttaattaattggaatgtgtgtgtatatatcagggtgccagtcttaatcgaggcttttaacaagttctatcccataattaattctgttgcggctagacttcctcatgtgtctattaatgatgcgtaagcacaatttttgtttttatttcccaagcttgcttcaaatatttatatgtacctgtctcatagatgtatatgtatgtatatatgtatgtttgttggtgtagtcgtctttgcaaagcgggaacacttgatcctagaaaagtaaggggaaagatactagtatgccttcgaggtgataaattaacttgttagtgagggtcaacagggtgctcttgccggtgctgtggcagtttttgtgcaaaatgatgagcaaagtggaaatttacttctggccgagaatcatgttttacctgctgcaagtatcaatggaacaaataatgaaagtcaaggaggtgcttttaacatcagcagcaagtaaagttcaaagttcatatatatatcactagtccctttcaaatgtcgtgtgtgtgtgtgtatatatatataaacacttaattaatttctacatatatatattgctgcaggggggtgttagcttacttgagtgcggcaagaacatatataggagtaaagccagctccaataatagctggattctcatccaggggtcccagttccgtgcaaccattgatactaaaggtctacatacattttgttacaccaacatgacatgatgattttccttcttacaattaatgactcatgtaagataaacttgccataatgtgtttctttttttagccagacataactgttcctgttgtgaacataattgctgcttttaacacaaggagcaggtccgtctaatattgcatcagatagacgtcgatctcttttcaatgtgcaacagggaacttctatgccttggcctcatgtagctggcatcacgggtcttctcaaaacatatcatcctacttggagtccagcagctataaaatcagctattatgaccattggtactaataattgaaattatacatttgaattacataataattttttaaaattatataatagttatattcttttttaatgttttttttattgaaacacataaatttagtttttttttctgaatttttattcaataaatactaaaattagttgatttataatgtattagttgtattttctttgtatgattacataataaaaacttgaaagatggattgagaatatgaacttagcgtgcatatatggacttagcgtgtcaccaaaataaaaaagagtatagttaagtaaagttttgattgtaaaaaagagagaagagaaaaatcatctgaagctagaaacctaagacaaatgaaaaaaaaattcacacaacagaagttgacttatgtccctttgttttccggtctttatccattcttttttattaattattgtttccttttgtttttgtaagcctataatcagaggcgaatttagaaaaataatcaagggagacactagtggtggactcaggaaaaattatttatgtctgcataagaaatttttttttgtaaaaaaaattaaaggaacaaacaattataaacaataatttaaaggaacaaacaaatagttagaccaaattattgttctagattaaatagaacaataaaaacaattcattttatactactagtctacatctcatcaccttcttatttgagcacaatagtacagtactaaatcaaacactaaaaaactaaaaattgcggcagacagatactaaataaaacactaaaattattccatctcagttcacaaatcacaataatttagtttgtaatataaagcactaaaaataatatgtccagtaaaaaacacactcacactcacatagaccaatttgtatttaatgaaaaaataaaaaaatattgataatttaataggaaaatttaagagagacacttcccgtaatcatgtacctaggatccgccagtgcctataatgacaaagagagactaaatcctacttggagtcgagctatcaaatcagcaattatgaccacaggtacattggtattagctatagtaatatatatgcatgctaattacaaaatactaccatatgtatatagcatatcatttggaaaaacattggtggcttattaattaacaactatgctttttatttatttcagctacaacactagataacacgaatcaaccaactcggaatgcatttgataagaaagcaacccccttcgaatacggcgccggacaaattcagcctaaccttgcaattgaccctggactcgtttacgatttacgcaccaccgattacttgaacttcttatgtgcttctggttacaacaatgctttactcaagttgtttggcaatttgaaattcccttacagttgttccaagtcttacagaattgaagatttcaactatccttcaattacggtgcatcatcctgggtcaaagactattaatgttactcgtacagttacaaatgttgggcctccaagcacgtatgttgtgaatactcactggccgaaggggattaaggttcttgtgcaaccatgttcgttgactttatttgggaatttgtcttggacagatggcaggcacagagtaaccagtcctgttgtagtgctgtaatgtaaccttagaagttagaagttgctctcagcattgttatgttatcactgtcatttgagtgtgtttgcgttttctgtttttaggctgtaatataagcgtgtttcctactcctgttgtattaaactttttctaaactagtaggtaggttaaaaattttgaggtattgaactttgttgcattggagctatgtttgtaatgggcacactctatcatgtatggaacctgtatctttgaaagtctaataggcattgttgagagttgagacccatatctaaataatattgaacaattttaattaggctccaatctatcaatttgccttcaccattgatttctcttctttctattttatctcgtgcagtcatgcattcatcttcagttactttggttccgaacatagaatacctctagatgagtggttgaggccacgataacctgagccttggggctgcaggatccgagcaaggcaagcgaaaaatggctatcttggtgacaccaatgcatatattcaggatttgtgatcgcagagtctccagatccaatagtgaatggaagacagggagtggtttatgtaacatctccttccagcttgttggctttcaggatgtgcataagttgtttgtgccatgtcggataaatggctgctgaaagtttgattggcaggttggtgcaaggttgaactcaatgatgttagagttagaggagcctataggcattgttggttgtggtagaagaggtggttcgagaggccatgtgggtcggaaaaaaaaaagaaaaaaaaaggttgattaagatatgctctaatacaatatagaattaccatataggctttggttgtgaacaataatacaaatatttacttattttaaacatttcaccatatgttttatttatcttgtctctttctatcatatcataaatcatataatacctatacttttcttctttttttctctctgagtttcttgtagcataatggatgtctaagaaagatttttcttagttttattgatttgcaaaggttatcagggatatgtatttataatagcaagcatttgaatatcagttggagcagctggaatatgttagtactgttggagtttttgtttaaactccatgggttatgaataagagacggttggaaaaaggttagaaaaataataactactcttaaccgctcctgggaaaggttagaaaaaataataactactcccaaccgctccgataacaaacgattgcgattgttcattgccaagagtcgcgatggtttaccgacaactcttcaacagagtgttttgttgtctataaatagacatagaaatagtcaaaaaaatagaaaagaaaactgatagagttttgatacttaatcttttctgatattctcgcttagataccaatgcattttcatatcacataaactcttcattctttctgagtggttcctcaaacattagctttattcgtttgggctgttgaattgaagtatcatcaaatcttcagacgttgatccgttttatcctaggagacaattgttgatcaacctttggcatcaattggagggaacaaattgtcttaaggagacaacattgttgggctcagatcctttcatctctttgtatttgtttctgattcatacttatcatataagttctgtttaaattgattttttgtgcaattatagtagattatatatattgttcctcttgactactcagattctgacccttgtgcaattgaatatattccaattctaaattaactaatagaattaacaatcttaagacaatttgtgaatctgggttcaatatattctatctttttattatatactgttgtctattctctgtacttttaaacgattaatctgtgtgattaatcagtgtttctgtttatgtaatagaaatgatttcaacaagtgcaaacttggtcaataacaacaaggctcactctgtttcaactcttgctgaaaatcctgaaaaattaaatggggttgatttcaagcgttggcaacagaaaatgttgttctatttgacaaccctatgtttggaacgttttctcaaggaagatgctccgaagttgaaagaaggagacgaacatgataaagagaaggttgttgcggttgatgcatggaagcactctgatttcctatgcagaaactacatcctcaatggtctagacaatttcttgtaaaatgtgtatagcactttaaaaaccagtaaggaattgtgggatagtctagacaagaagtacaaaacagaagatgttggcttgaagaaattcattgttgaaaaatttctggacttcaagatggaagactctaagaatgtgatgagtcaagtggaggaacttcaagtgttagtgcatgaaattcatgttgaggggatgaccctgagtgaatcatttcaggttgctgcgattattgaaaaattaccaccatcctggaaggatttcaagaactatctcaagcataagcgtaaagagatgacacttgaagatctgataataaggttgaggatagaagcagacaacaaagttgctgaaaagaaatttggcaacaatcctttggtctctagggctaatgttgttgaagagggatcaaagtccaagaaacgaaaatattctgatgttggaaatgctaaacaaggcaaaggtaaaggaaaaaagttcaaaggcaattgctacaattgcggtaatcctggccaccgtgcaaaggattgcaaaaagtcacagaaatccaaaaagaagactactcaagccaacttggttgataccgcttgtggagaaattgaaaatctcaacttaacagcagtggtgttggagtgtaaccttgtaggggacactaaggagtggtgggtggataccagtgccactaggcatgtctgttcatccaagtggatgttttcctcctacactcctgtgaagaatcatgagaaactctatatgggtaactcttctacttcaaaagttgaaggtattggaaaggtggctttaaagatgacttctggcaaggttgtgacacttaatgatgtgcttcatgtgcctgatattctcaagaacttagtgtctggatcccttctgagcaagaatggatttaaacttgtatttgtttctgataagtttgtacttactaagaatgatgtgtatgtaggaaaatgataccttagtgagggcctttttaagatgaatgtaatgactgtaaccaatggtggtgttagtatcaacaataatgtcacttctgtttacttgcttgagtcttctaatttatggcacaaagattaggacatgttaattttaaatcaattaaaagtttggttaatttagatttattgcctaaagttgaatgttctaatactaaatgtccagtatgtgttgaatcaaagatttcaaaatgacctttttcttctgttgatagatcaactgaattgttagatttaatacatactgatatatgtgatatgaaaaactgtaccatctaggggtaataagaaatattttattacttttattgatgattgcagtagatattgttatatttatttacttaatagtaaggatgaagcacttgttgcttttagacaatataaaaatgaagttgaaaaccaacttaacaaaaaaattaaggctataaggagcgatcgtgggggagaatatgatggccccttcaaggaattctgtatagaatctggggttatacatcagaagactgctccttatgcaccgcaatcaaatgggattgcagaaaggaaaaattggagattaaaagaaatgatgaacgctatgttaatcacgtccggtttaccacagaacttgtggggggaagccattttgacggcaaactatattattcatagagttcctcacaagaagacaaagagcataccatacgaagtatggaaaggaaagcaaccatccttgaaatacttgaaagtgtagggtgcttggctaaggtcgcggttcctaaatccaaaaggttgaagatcggacctaaaactgtggattgtgtattcattggttatacacttaatagtagtgctagttgatttttggtttataaatccgatgtctcagatatacatgttaatacgattattgaatcaagggatgctaggttttttgaggatatatttccgtataaaaaggcatatgaaccaagtggcaatgacgatgataatgttgtgagacctcaagagacttcaactagtgttaatcctgtagaggaagaacctagacgtagtaagaggcaaaggaccaccacatcctttggacctgattttctaacatatctgttagaaaatgagcctcagaagtttaaagaagctgtaatgtccctagaggcaccattctgggaagagactatcaatagtgaaattgaatccatcctgtcaaatcacacttgggaattggcagaccttcctcctggcactaagcctctaggacgtaaatgggtcttcaaaaggaagatgaaggaagatggcactattgataaatataaagctaggcttgtagtcaaaggctataagcaacgcgaaggtctcgactactttgatacctattcacctgttacaaggattacatccattaggatgttagtcgcgctagcagcgttgtatggattagaactacatcaaatggatgttaagacaactttcttaaatggagacttagaagaagagatatatttggaacaacctgaagggttttctgttccaggacaagaacagaaagtttgtcgcttaattaaatccctttacgggttaaagcaagctccaaaacaattgcatgcaaagtttgataaagttatgttatcgaactattttagtattaatgaatgtcaagtgtgtacattcaaaatactgataaagggtttgcaatagtctgtctttatgtagacgacatgttgataatgggtagtaataatcaaatgattaaagctactaagcaattgcttgccagcaaatttgacatgaaagatttgggaagaacagatgttattttgggtatcaaaatccatagaacatcaagaagtttggctctatcacaagctcactatattgcaaaaattcttgaaaaaattcaagagtttaaatataactcctgtgaataatcccatagaatctagtcttcgattattgaagaatactgcaaagctaaagcacaaaaggaatatgctcaattattaggcagtcttatgtatgctatgaattacactagacctgatattgcttatgcagtgagcatgttgagtcgctttaagagtaatccaaacgtgtatcattggaaagctatgataagagttttaagatacctaaagcacactcaaaactttggtttgcattacgaacagtaccctgccgttattgaaggatattgtgatgcaaattggatcaccgattctaatgatactaaatccacaatcagatatgtgttcgcccttggtgggggtgctgtatcttggaaatcgtccaagcagacttgtattgcaagatcaactatggaagcagaatttatcgctttagataaagccggtgaggaagcagaatggcttcgtaattttgttgaggatggtcccagttggtcaaaaccagtaccagctgtaggcatacattgtgatagccaagccgccattggaagggctaagaacgtcttgtataacggcaagtctagacatatgcgtcgtagacatgatactgttagacaactactctcgaatggaattatctcaatagactatgtgaggtctaaagagaacatagcagatccattaactaaagggattcctagagagctagttgaaaatttgtcgaaaggaatgggtttaaggcctatcaattgttgatcatcgcggtaactctaccttgatgagtggagatcccacgaactaggttcaaagagacaactaagtcatgattgattgttaaacactgtggagtttttaaactcatactcattcctatgacaatatagtgtatatgagggtaagcataacgacttttaatggtttcttaatctgatgtgttcagatgatgtatgtggagatatatcacaagaaatcacctatgtaagtgtgaagtgagggtcgcttcaatgagaacttaaaaaggccaattctctacaacacttgcagaaccaggaaggtgtccacgaccaaaatggacacaacaatgaggacgagcaatgctagggaagcaattgtgtgtctcctattgtctcggtatacaccataaaggtcgatggttcaaggcatcacgaccaccgattgacctagtatacccgataggtttacactagagaatgttcaaatgtaactcctacctatctcgatgcaattgtttctcgccgaggaatcacacttggatacatattcatatgcatttagttatgttgaattgatctcttattcatgtgggggattgttggagtttttgtttaaactccatgagttatgaataagaggcggttggaaaaaggttagaaaaataataactactcctaaccgctcttgggaaaggttagaaaaaaataataactactcctaaccgctccgataacaaacggttgcgatggttcatcgccaagagtcgcgatggtttacggataattcttcaacagtgttgtttattgtctataaatagacatagagacggtcagaaaaaaatagaaaagaaaactgatagagttttgatacttaatcttttctgatattctcgcttagatactagtgcattttcatatcacataaacttttcattctttctgagtggttcctcaagcattaactttgttcgtttgggttgttgaattgaagtgtcatcaaatcttcagacgttgatccgttttatcctgggagataattgttcatcaacctttggcatcaattagagggaacaaattgtcttaaggagacaacattgttggactcggatcttttcatctctttgtatctgtttttgattcatacttatcatacagactctgtttaaattggttttttgtacgattataatatattatattatttctcttgattactcagattctgactcttgtgcaattgaatatattccaattctaaattaactaatagaattaactagtactcctacatagatgagtgcatagagatctcatacgactaaaccattcaaaagagcattttcaggtgccaataggatttaaactcgaactagatggcggttatttcctaattttgagatcgtgaatcctatcttcctaatcaccaaattctgtgataataggctgacataaaattgattagtccagacttcattttttatcttacaccttattagaatcggtcttcttttaggcaagaattgttctttttataaaccagaaaaaaataataaatatataaaatgactttcccaatttctcaacatcaaaataaaataataaaaaattcaagtgagaaatcgggtttgagaggtcaagttctctaagtgaacagtaatggtgctagaagtacgtataaataatctgaaggggtattatttacgtaattatcttttattttgtattatttgagtaaaaaaattgactgaatgatttcttatttattgatggtacacaaatctttatttatctgcaaaagaatttttatttacataaatatatttgttaacattttacatgaatttttttccctcaatttgtatttataaaaattaaaaaatgtcacttttttcttttttaaaagaataataaacataatgtataactataatttacaagtggggaccacagctgtttttttttttttaatttggatgcattaacattacaggaggaaaagtcactgtcactttgaccattagattaatcttatcatccaaattttactgcttgttttaaaagattttaaaaaaaaattaatttttactttagttattaatttaacatttttttactttaaacctataaaaaatactactaagagtttagattaattgttacgaggtatttcaatttagcatatgattttgagaaaaaactttattgtctataaactataacaattttatctatctcaacatgattgcatttgataaaacataccgtggataaaaaaaatgtcgtatattttgtagcagtcttgctagaaatatctttaacagtcttatatttatcaaacattttctgacaattttctaaacaatataaaagactattgattaaattgaaataattttatactagttagtggttaagctacactctcaacaatatatttatgatttcaaaatatacaagatataaaaactaaattagtaatcaaattaaaaaaatctttcaaaacagtgataaaatatgaactatcaaattaatctaatagtttaaaataagattaagaatctatttagataaaagttagtgttttggagaatttttttattaaaaatatataataagttatgaaaaatacttttattaaaaaataattctaaattttccaataaatccaatccgtattttctgaggccacgctaggtacgtactttcacattaaacaggagcagttttttttgctatttcattagactactagttctgatcgaggatccatcatcttctgctatttcattacactatcatctactagctctgatcgaggatccatcatcttctgctagtccataatcacccaatagctcaaatatgatgttctctaagctttcattaattcgtctaattctctgttcactcttaagcctccactcctcccaacttttcaagtttacttcttttgcctttgctgccatcactgctgaaaaccatgagagggaagcagctgctctacttgagtggagagtgagtcttgacaaccaaagccaagcttctttgtcatcatggtccagtgctgcaagtccttgcacgtggaaaggaatcgtttgtgacgaatccaactatgtgaccgctataaatgtggcaaatctggggctaaaaggtactcttcacagtctcaaattttcatcttttcccaagctgctaactctggatattagtaacaacagttttaatggaatcattcctcagcaaatttctaacttatctagagtttctcagttgaaaatggatgctaatctttttcatggttcgatccccatttccgtgatgaagttggctagcttgtctttgctagacttaacaggcaataaactttctggtaccattccatcaattagaaacttgacaaatttagaacaccttaggctcgcaaacaatagtctctctggtcccatcccaccctacataggagagttggtgaatttgaaatttcttgattttgaaagtaatagaatttcaggatcaattccttcaaatattggaaacttgacaaagctcggcattgtatacttagccgataacatgatctctggatccgttcccacctccattggaaacttgatcaatctagagtcgctggacctgtctaggaatactgtttccggagttattccttcttcccttggaaatttgacaaagctcaattttttgctagtgtttaataacaaacttcatggtacattaccaccagcactgaataactttaccaaactccaaagcttacaactatctacaaatcgtttcaccggtcctttgccacaacaaatttgcatagatgggtcactgagaaaatttgctgctaatggtaattctttcaccggtccagttccaaaaggcctgaaaaattgctccagtcttaccagagtaaacctatcaggaaatcgcttgaccggaaatatatcagatgcttttggtgtatatccaaagttgaactacgttgatctgagtagcaatcatttttatggccacatttcaccaaactgggcaaagtgtcctggtctcacaagccttatgatgtccaacaacaatttatctggtggtatacccccagaactcggccaggcacccagcttacaagtactagtcttgtcttcaaatcatctaacaggaaaaattccaaaagaacttgggaacttgacctctttgtttgatctatcactaggcgacaatgaactttttggcaacattcctactgaaataggtgctttgtcccgcctcaaaaatttggtgcttgcagcaaataatttaggtggcccaattccaaaacaggtgggatctttactcaaattagttcacttgaacttgagcaacaacaaattcacagaaagcattccttcgtttaaccaattgcaatctcttcaagatcttgaccttagtaggaatttgttcaatggaaaagtaccagcagaacttgcaactttgcaaagattggaaactctaaacctctcacacaacaatctctctggagccattcctgattttaagaatagcttggcaaatgttgacatatctaacaaccaattggagggttcaattcctaacattcccgcctttcttaatgcttcatttgatgcattgaaaaataataaaggcttgtgtggaaatgcctccggtttggtgccttgccaccccctacctcatgataaaatgaaaagaaatatcatcatgttgccattactcctttctttcggcgctctatttctattattattggttgttggaatttcgttttgtatttgctaccgaagagcaacaaaggccaaaaaggaggaggctaaagaagaacaaaccaaggattatttttccatttggagttatgatggaaaattagtgtatgaaagtatcattgaagccacagaggggtttgatgacaaatatctcattggagaaggtgggtctgcatctgtttataaggcaaatttatccacaggacaaattgttgctgtgaaaaaactacatgctgtacccaacgaggaaacactcaacctaagagcttttacaagtgaggttcaagcctcggcagaaatcaagcatcgtaacattgtgaagttaattggatattgtttacatcctcacttctcctttttggtttatgagttcctagagggaggtagcttggataaagtactaaacaatgatacgcaggcaacactctttgattgggaaaggagggtgaaggttgttaaaggtgtggcaagtgctttgtaccatatgcatcatggttgctttccttctattgttcatcgtgacatatcaagcaagaatgttcttatagatttggattatgaagcccgagtctctgactttggaacagctaaaattctgaagcccgattcacaaaatttaacctcgtttgcaggcacctatgggtatgctgcaccaggttaggtcctttttgttattaagaaatcaaaactatacttgtttcaataataagtgctgccacttgttgtatgatactattttcatatttaatttgatatattacagagcttgcttatactatggaagtgaacgagaaatgtgatgtcttcagtttcggagttctttgtttggaaataatgatggggaagcatccaggagatctcatttcttcattttttacatccactggaacgtcatcagcttctaatttgctgttaaaggatgtgttggaccaacgaatacctcaaccagcgaagccagttgacaaggaggtgatcttgatagcaaaaataacatttgcttgcttaagtgaaggtccacgttttcgcccaagcatggaacaagtgtataacgagtttgtgatgccaacatcatcttcagtgaatttattctccatggtcacacttggtcaactcgtagataattgaaccttcttgtttcctgcctgttgtaagcttttttattgctttaactagtgaacaatctcagcacggtttaccgtagactgaatgtagatcagtaatgatcaaaacagaataacatctgtgtgactgtgtctcacattctctttattcctcaactcactgtgttgttgttatacataatgtttcttgatttctatatgctgtaatcgtgttagaatcatataaattgcattagatttacattggctatactctccacatctcaattacacaattacataatctttttgtgtctataagttttcaagaaaataattttgggactgatttttagaaattcagttctccctttctttggattctttaccatttgtctaataacatatattctaattcatatagtcttcaaaatatccatatacgagctttctggcggatatatttagccctagtcctaaaaaatatttacttgaagagttttccgtttgtaaaagagttcaaccttgttattccgttagttctgtaaccattgtaatcgattattgcttcaattaatcaattaaactatccaacaaaacatcttggttcacattcagatcaatgtaatcaattaatatgacaagtaatcaattattactgaactagtattttgaaactagtatccaagcaaagcaaccaattatgttaaatggtaattgattattgccgaatctactgctttttacaaaaactagttacagaggtatgtaacataatagttttgctggtacaagaagtttctatgaaataagaaccgtgagaggtatttcattcatacagcagcaaaatgttatgtttctgatccatatactgactgacaaaatagcacagcagatttctactacctaacctaacaggttaatgagccacctgtccaacataaatacaaagcttaagacactccaaaaggtataggtggttgttctttagtctgaaaatacattaattactgcataaaatattaatagttttcaaccatcaaattaacaagattctttgatttaatgattcatgcattgaaaaaacttatttaatgctagcagataccatgtagaaattgggactaatatgccaagtagttagcactttgtttcttgagagaggaatgaactagcaaaattctaaaatgttagataccctgtcgacaaattttgtggcagaatgtccaaaaatacatcatgcatatatatatattgcggtccgcactatacaatttgacgaatttgtacatttaaatttcacgtgaaactttggccccttcgacgctggttgtttctggattcagggaaacatatatatataatcatgcattgtaacatcaaattatttacgttgttgcctgagttagaaatggaatatatatggggtcaaggggatgatatatataaggattaacttaatatttttgtttgattctcattagaattttcagattagtgaataattatatttattaattaatattatatttattattatatttgttctaatttatgtttatttttttatttttataagtattataatattatgtttataatgattaaaaaagggagaaagatgaatattaaattatattttggataaataatcactttcatctatgaaaatttaaaatattgacaaattcttccctaaatgtagcatataatctcattcattaacgataacagatggaaattaatatattgataaatttgtaacattttttcactttcagaaattaaaattaaaactttcattttttataaacaaatttatccgcactttacatattcaaaaataaaaataattatttatcctaataataataatgataaaagtatcaagtttgagacgaagggaagaaaagcacatactgcctttggctcgtttccaaacacacttttccttactttattctgagtttcctttattgctaggcaactttgtttatagtgataatgcacttttcttaaagtgaagaaagataatttattttaaattaatcattagcatctcaacatatcatttatattataaaatatgtcaactgtttttataatttatttttttttctttttcattcttgtaaaaaaaatgattttttataaaatatttttttcttaaaaacgttttaaataatatttttttattgttcaaaatatttattttattgttcgaattacaatctaaatcattttaaagatgaaaaataaaataaacatactttaaaaggactaaaacaaaaaaaaaagccattataaaaatgaaaaaataactaaattataaataccaaacaagtatttaagcctatgatttttttccataataaactgagagggacatacgtagaaaaccctgaacaagaataaagggctaaggcttgacaatgtaaggtcttggaagaattttttttattcatctccaatttataaagaaagggataatttctacccttttgcttgtttctttttcttttcatataattcttgatctttctaactaagggttgatagactcgcacaactagattgtaatgtaattgaattttactcctaattcatgttaaaatttgtcatttagttattaaatatccactatcttctcttcagcaatacaattttaaatattcactgcaaatatatagtgttcctagtaaatttaagaataaatatagttattttaaatagaagtatatatgaaaaaataattaataagacttttaaagcatcaacaatgttaaaataaaaaaggtaaaataacaatagttatgaaatggagaaaaataatttattgttcataaagctatatgtacataacacccacaaaacttttaaaaattgatgttcttataagcatatgctactttaagaatatttaccaagaacctgttccaataagcatttcttaggatgtgcttaatagaagaagaaaagaatatataagtgaagtgtttgataaaataagtgagaaatacgataaaaataaaagtatttgattttagagaaataaaaaaaataactattcatttatttatttatcttttttttttgttactaatcaatattatgttgattttttcctttttatttctttgaacaagttactttttttttttctaactatttctttctgttccttttttaagtttcaccacatcagccacctcggatccgatggacttggaggtgctttaatagatggctgttgccctgtttcgctttttacggagcctaatctttttccaccaaaaaaagaaaaagtcttattcccccacgtacatgaacaaagtggctaaaacatgcagcattttggcaaaaaattaaaaataatacaattaaataaaaaaatttgagaaatggtgtaagctagaaaatatttggtaaaatggtacaaccattcacgcccaaaatagatgtgttacaacacgcccaaatggggcgttttcttacagacgaggccacgtgacagtgttcaggtgtagcgtggttgttttccgtaaatttcggaaggtcataactgttgactggggcgtccgattgaggcgaaaccgatggtcacgcgatcgttgtttcgaggagaagcccttggcaagttcctaaaggagacttgcataaaattttttcccaaaagaggcctctaagtgcctcaaaattgcgatttaatcgtcgaagctacaaaaaatttcgtgtttgctaattttttattgattcaattagtgaattgcaatctattctttgtttatctaattacttctcttaatttcgagcgttctgacataaaatacttcaccatcggacattgctacaagaaattacgactgttcaaagttatatgcatcgtcaattttacagtataattttggattatttatttatagtgtagaattgacgatgcatataactttgaacagtcgtaatttctcgtagcaatgtccgatgatgacgtattttatgtcagaatgctcgaaattaagagaagtaattagataaacaaagaatagattgcaattcactaattgaataaataaaaaattagcaaacacgaaattttttgtagcttcaaccattaaatcgcaattttgaggcacttagaggcctcttttgcgaaattttttttggacaagtcccctttaggaacttgccaagggcttctcctcgaaacaacgatcgcgtgaccaccagttttgcctcaatcggatgccccagtcaacagttatgaccttccaaaatttacgaaaaaatcgcgctacacctggacactgccacgtggcgccatctgcaagaaaacgccccatttggacgtgttgtaacacgcctattttgggcgtgaatggttgcaccattttgccaaatattttctaacttgcaccatttctcaaatttttttatttaattgtattatttttaattttttgcccagcattttcgttatccgagtgaatatggaagagaaacttagagcatatttaattattttttatttttaagaatttgttgaataaattatttatataaaatacttagatttaaatttaaaaaatctacaatattaattggattttctctaactacaaaaaataagaaattattttttatcttaaaaaattcatcaaacatcttatattgaaaatcaacttagcaaaattcctcttttttgaacggtgatgtggccatagtcaattagtcattgacttatgattatctttggaataactttatcttctctctcctaaaaaacagagacaatacataaattggctgtgaatgtgattggagatggagaaagctcgtaggaagagaggtcaagcattcatatattctctgttgttatggtaggtagcagtggtggtggtcactaaaaagaaaaaaatatagtgtgtttagcaaaagaaaatgaatttgacataaaattaaattatttttttaactcaaaatagaattataattaagcaaagtatatgatgtatacatattttaattttgatctaccatatatgtatatggttaatcaatagaattctacgtggacatgagtatcgtgtgtttgaattaattttatggtgagaattatttaatttttttagtaaaagtaaagtaaaaataccctctaaattccaaagtaatactttttttagtcttttggttttgtatcaaaattttgattcttttaacttttttatgatatttttttcacgagatcttatgtttggtaagattcttgaaaaatttataatgttttactagtttataagttactttaaagcttgtaattggtacatacacaaacttacctcaagtaatttatttttgtaagttaaagtaacttatttttcataagttatttaaattaaatttttcataacttacgaaaaataaataaacgtacaagtttattattaacctttttttctcaattttatcatcaagaggataaattaatatttgtattcaaaagagacgctaatcatgaaaataaaatttattaggaaacaattttattataatattttttattttttatttcaataaatatattattaagtgtgtcaagataatgatatttattaattagatgacagaattaaaattggtcaatatagaatttcttatgacgctnnnnnnnnnnnnnnnnnnnnnnnnnnnnnnnnnnnnnnnnnnnnnnnnnnnnnnnnnnnnnnnnnnattattgtgaataattgaaaaagtatgatttatagaataattggtgataattgtagttgaaaattgaaaatattttagtctaaatctatgtcaataaaatatttcttaaaagtatgtttggtatgacttttggtattgtgtgttgtatgagaaaattaagaatatgttaaaaataatattaaagagaaattgtaaattcttttagggaaactcattcattttatattttattttaattttaaaaaattattttatttctattctctttattctgatcttctaaattaaatacatcataaaaataattaaaattgcctttctaatctcgaactttgtgcactttaactaattctaatctcgaactttgtgcactttaattcctttgtgttttatctttgtttttttctatttattttgatacctatatctttggttgattaatcaaacagggatttttctttctttctttctttctttttttaccttttttattaaaaagttattgatttgaaatattttatgaaaagaaggcactttatgcaacgtttgtactaaaattaagtgggctggaatgtttcacgtgatcgagaactactttttctcgtaaattattaattgttatataatttaacaaaactgctcttaatataaaattcatgcactgtttgtaattacataaacttctgcttaaaatctttacaacaggttagtgactactatcttaaccattaaattatcaaataaatatacgatcaaaaaaattatcaaatcaataaatctattatgtaacttacccattgctgagaaagttattcacttccccatgttagatactcctcctctttctattgttacaaactaatgccaatgcattgtttggcttatgcagaaagacagtaattatatttggtagaaagataatatttacgtagaaattgaaaataacgtaaaaaaatgataggaagagctgtaagcaggatcttttatcaaaattgtcggtggtgctgttgcaatttgcaataagtaataaataataacagaggtaggcattgaagatgtcactgctggtgtctatgtaaagaaaataggtgaaagttacgtaagatacagagctagacttaccctatgtttggaagaggaaaaaataaaagagagaaaagaaaacttcaaaatttaaattggagaaaaaattaaaaatagaaaagttgtaattttttttttttctaaaagtgagttactatctttgattttttttttctcaaaccaaataagagaaatatatagttatacatgtttttctttcttttaattttcttttgttttatttgtgttccttccaagcgggcccttatagagtgaaagacttttttttctgagtgacatatggtgattggtcagtggtggaagatggcgtaggcaaatttcgaaagccaataatagtaaagctttatgcgcaaaaacctacataaaattttataatatatatacattctttgggtcttacttttttatttttattacatcacattatttactatatttttcaactttatttgaaaggatgatatatttatcaataagtaagcatatatacctttcgtaaataattcgtttttaatattaaaataatgcttctagagaatggtgaaagcagagttatattagggagcaatgataacggcatactcttttttttagatgcgtgtatgaataaaaataataattcctatccacaccatttttaatcaaagttaattaaaagtaaataataaataaattcaataataaataaaaaaataaaaaaattaaaagatgaaagaaaagaaaaataatagaaaaaataattataaaaaaatcatttataatataaagataacaatgaagagaatgatagatatactaaataatatataataactaatgaacaatgaagagaaaaagaaaagaatagaataaaattaagatggaatatatataagcagtggcacagccatggattacatccacaccaaaacaacaactgaagatatattatggcattctccatcttcaaacatgttctgtcattcttccttctctgcattttcttgcaggaaactaccaatgcccatagaaaggctagttagctagcttttgccttttagttcccccgttacggttttcaataaagaatctgatggagttttgccatcatctcttcaagttccaactttaagaatttccaaatttatattttgttaattaatgtaccataaaacatttcaccaattgtgtgctttgaattctgtgttttcagacctacattgtgtacatgggaggacattctcatggtccagatcctttgccaagtgatcttgaaacagccacaaactcccatcatgatttactcgcttcttacttaggaaggtaacacaaatgttaaattatgttaaatataattaggacgtgcgtgttaattaaaacttgataatttaacagtcatgagaaggccaaggaagcaattatgtactcgtacaataagcacatcaatggctttgctgccctacttgaagaggaagaagcatcacagattgcaagtgagcaaagactattaccattaacatgaccatgattttctactcatcttgaagccacacaaattgatataatcatgtattacatgtttctattggtacagaaaatccaaatgtggtttctattttcttgagcaaagagcacaaattgttcactaccaggtcatgggattttcttggactggaaaaaaatggaaaaattcctgcaaactccgcttggaggaaagcaagatttggagaaaatataatcatcgctaatattgatacaggtatgcttagttactctcttttttttatcacagttcatcgtgctcttaattcagtttacattattttcttcttcatgaatttgtactgcaaacatattttccttttgtaaatacgttagttgcttcttgaacaggggtttggcccgaacaccccagtttccacgacaaaggatacgggcccgtcccttcaaagtggcgtgggaaaggtgtctgtgagatcgacagttttaatggtacaaagagttatctatgtaacaggtaatttttctgttatttcatttcaaaaattgggttgagcgtgaaataatatatgtattttaaaacggtgtgatgatcacgattcacggcaatggaaggtagttgttattttatttacagcttagttaatgttttatctgtataattttggctcttattttctctctctctcgcaattttaattcatttattataaataaattcacaattttaatctaatctttaattatatacacttttttgttttaattaattaaattagtttttagtttgttaaatgtttaattttcaatcctcaatgttagttaaaattaatgtaaaaaaaagtgtgcaaaattaggattaaattaaaattgtgaattttataaaataaaaaaactaatatcgtgaaaaaaaatagagatcaaaatattagattatgatttataggctatcaaaattataatttagctattctattatatttttattttgtgtttattaaggatgtgtttgaaactaaagaaaattaaactaccaaagtatatttgatggatagaaatataggtgtagacattctattatatatgtattttttaatttaaaattatagaggagtattacgtatttttgtgtttattaaggatatgtttgaaataaaggaaagagtgtgaaagtatcctagatggatagaaactatagttttagtcaaataaaatactattttttattattcaaataagtaaaaaagagtacaataaagaaagttagtatacaaagctcctacacaatgactattgtggttgactattgtggtttcatatgaaaaagtctgttttcttttatataaatatatatatatatatatatatatatatatatatatatatatatatatgctctgccctccaaatccatatttcaaatccaagttcagaaaagaacaagaataccccaatcatttttccaagagtcacaagaccaaatgagtatcataatagcatgcaagcaattttggagccttttgggttttttttatcataacattacatattttataaaaattcctatgatatttttaaaaaaaaaatattataaactatttattgctcatgtcaagaaaaattcttgaactcgttgatgctaattgctatcacatgtagccctaatattattataattatgatgaatattcaggaagttgatcggagcaagaatttttctaaaaaatcgggaggccgaagataagaagattgacccaaggctacgcagcggacgtgacttcgtagggcacggtacccacacactgtcaactgctggtggtaattttgttcgcggtgcaaatgttgaaggtaacggcaatggtactgctaagggaggctccccaaatgctcgtgttgtagcctacaaagcatgctggaataatctggacacaggaggatgccatgaagcagacatgctacaagcatttgatcatgccatttatgatggtgttgatgtcatctctgcctctgtgggtgcgtctaatccctataaggaagctttgttaacagatgggatttccatagggtcattccatgcagtcgccaaaaacatagtggttatttgctctgctggaaatgatggaccatcacctttaagtgtcacaaatgttgcaccctggtccttcaccgttgctgctagcacaatcgacagggattttatcagcaacatttctctcagcaacaatcaatccattacggtaagagatctaatctagagattgatttatttcatatttttactatgtcagcttaattgaaccgtacttgtatcagggtgccagtcttaatcgaggtttgtcaccatcatcgccgtcacaaaagttctattccgtgattaaatctgttgacgctaaacttcctaatgtgtccacggatgatgcgtaagcacagttttatttttttgtttcccaagcatgctcaaatatttatatatacttgtcttatacgtttcgtgtgtatatatgtatgtatcttggtgtagccgtctttgcaaaccgggaacacttgatcctagaaaagtaaggggaaagatactagtctgccttcgaggtaataaattaacttcagctaaagaggtccaacagggtcatcttgctggcgctgtctcagtttttgtgctaaatgatgagggaagtgggaatttacttctggccgaggatcatattttaccagctgctagtgtcggtggaaaaaccaataatatttttaaaaatgatgccaatggtaaaggcggcagtaacaagtaaagtttatatactaatccatttttaaatgtcgtattctagatcgatctctttctctgtatatatatatatacttgcagcaaagcaagtgaagcacttcaatattaatttatatatatgttgttgcagggaaattttagcttacttgaatgctgcagaaacacatataggagtaaagccagctccaatcatagctggattctcatccaggggtcccagttccgtgcaaccattgatactaaaggtctataatatatacattttgttaactacaccaacatgtcatgatgattttcgttcttacaattaatgactcatgtagagatgaatttacaataaatggtttcttttttcagcctgacataacagctcctggtgtgagcataattgctgctttttcacaagccgcgggtccgactaatcttgcaacagatagacgtcgggttcttttcaccgtgcaacagggaacttctatgtcttgtcctcatgttgctggcattgcgggtcttctcaagacatatcatcctaattggagtccagcagctatcaaatctgctattatgactacaggtacgtacgttcattaccaaagtaatatcaatataaaatgttcatccacagcaaatcattggcggcttattaacaactaactatgctttttatcaatttcagctacaacactagacaacaccaatcaaccgattcagaatgcatttgataagaaagcaactcccttcgaatacggcgccggacacattcagcctaaccttgcaattcaccctggacttgtttatgatttaagcacaaccgattacttgaacttcctatgtgcttctggttacaacgaagctttactcaagttttttggcaatgtgaaatcccattacacttgtcccaagtcttacagaattgaagatttcaactatccttcaattacggtgcatcatcctggctcaaagactattaatgttactcgtacagttacaaatgttgggcctccaagcacgtatgttgtgaatactcactggccgaaggggattaaggttcttgtgcaaccaagttcgttgacctttaagaaaactggagaaaaaaagaagtttcaggttattcttcaggccattggtgtgcctggtcacaacattcctttatttgggaatttgtcttggacagatggcaagcacagagtaactagtcctatcgtagtgctggacacttagaaattactctctgcattgttatgttatcatcattcccattttaagttgtttgcttttattgttttttaggctgtaatataagcgtgttttctgctgatgttgcattgaagtactttgtcacaaaaaataaaaggcacaatgaacaaatcaggactgcgggatgcggtgattaaaggttaagattgttgtgcctgcatgtaatttggcatatttaagattgttgtttccttttccttttgtgaaaaacagatgaaactttcattatttaactaccttttctactcgatcttagcaacttgttcttttccttggtgtctcataaatcaaacacggagacggagtcatgatgatatttacttgactttgtagattgacttgatccaaaaatccaagtcaatgctggctataattttgtaaatttaattaataggttaagttgtaattttaatcccctaattttttaattcatgtcggttttccttttttttaattgtaatatttgattttttaattttataaattgataattttagtctccttaatagattattaattgtaaataatagagttattaaattaattataaattaattataaattattaattattaaaaactttaatagaagaattattaatcataatcttctacattattagctcctcttatcctatacaacacttctttcacctccattgccgcgattttactggtagcaacaatgcattaggaataataatcttttattaaattttttgaagattaataaattttatttaacttataattaacttaataactctattaattataattattaattaataatcaaccagggagaccaaaatcatcaatttataaaattagagaactaaatgttataattaaaaattaaaaaagaccaaatcatgaatttagaaaattaagagggactaaaattacaatttatcttaattaataatattgttaaacaaattattgatccttgccattcatttttgtgaattttgtagtctatgtatgaaaggaaaaattatttataaattacacatacatcccttaaagttttcatttattatattaaatattccttcatttttttcagcctacagaaaatcccttaatttaaatatttaatggctctcataacagcagctacccctcaccctcaaacattcttaactctgttaacagaagcgcacacgtgactgacacactggtttttaatgatattatgtttcaagaatgtcctttatttgctacgtactgatttccagcccatgaagttgaagcacggtccaaaaatgacgatttaatttccttcttaaaccattttatctggagttcacttaactataaccgaaaaaaaatagaagataaatttcaaaaacaaattaagatagaccttagggaggtaaacattaaatatcttagactcaaaatccaaagttgttcctgcctaaagatagatggtcaaatattttctcttcttgtcgggtttttcttccttcttgttgtatcattctttttggaatgtctttctttattgttcagcaaaactatcttttgaaaaatgtgataccgcaaaagacattctaacgttcaaattaggtctcagtgtaaagaaaatagtaaatatagtaaataagtaaatagaataatttgtgatactttgagaacttaattagtcctttatatacgtgtatttatgggccgccttacctcttaattgagggcacgtaaactgaaattaccttatagtgttaatataatattaagattagataagttaattttttttaaccttagtggggtggttaacgagaggatactaaactatgctaaaaagatttcaagttgttatcgagaagatactataccatgctgaagggatgcataagtcatgccaaagaagacaagctagagtatcacaattcataaggaaaatatactatgtttacttttaaatgttcatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatctattaagaatttaagatattatttattaaaatttaaaaagaaaatttaattaaaatacactgtcattcatatatatatatatatatatatattatatcatatatgataattttttataataattaatttaaaaattatatatagaatgatttttttattgattaatatgatataaaaaaattatattgacggtgaatgaaaattaggctcttaaaaataaatatatattttggcttcaatatatttttcatatttgtaatatactattttttccttaattatttataattttgtttttcaaaatggatcttgtaaaatttcatttttggttttagtctttgttattttgttttagtcattgtaatgtactatttttttgttttatttattataatatttatttatcttgaattagtctctttgaattttttttttaataagaaataatttttttattatattataaaaattaacataaaataaaaagaataaaactatttttttacaagaaacattttaaaaaataattttataaggaaaaatatattatagaattaaaaatatatttgaaacatttttcattgaaagagtttttttttctctatttctatttttaaaaattcaaaatttcacttttttttaatagaataaaaacattgaacgagttttaagcataacttaataaacactccaaaaaatttcgaccgtaagtgcgcttttgttcaatttgtagggtacacgtgctttcagtctttcacatattgaccatgaccagttttctgctattgcattataactactacatccaccctataatttttttgagaatttctttttcgataacagcatctccaacggaagtgttttcaggtttcttcagttgaagaacttaaaaaacttatgccttggagtttgtttgcatggtgaaatcgtttcgtcaaaaaagatatacgttcgttatataaggaaatgaaacttatcaataaaataatattattctcatcaactatcctgtaaaaaaagaggaaaaataatacatcagattgtggtgccacaacgacggtggtgcttggaagagactgtgatgatggtgccgctcgaaagaggctgcacgcatggaggaagaggtcggcgtgcaaggtggaggccacacggaggaagaggtcgcatgaggaagacgacgccttagtggagaagcacataaagaagagagaaaggtgtgggctatggataatgagaggtgagtggagaggcacgtgtgaagggtatggaagaatgtagaagagtttttttttttttttaaatgcataaagaggaaatgaaagtaataaatatgaagtaaaaaaattgtaactgtggattaaaaataattgttgaaggctgaaatttaaaaatagttgttggaaaaaaagttatcatcgaaaacgaaaataataataattaaatttatgtaataatttttttcatcattatgtttttttatttattttgatgttattttgtttaactatatattattatgtaaaattttattatattgttatgtatttcatttcaatgttatgtcattttattatttttattttatattttatttttttaattattcatattttttatttgtatttataaaaactgaaaaaatgttaagttttaataaaaaaataaatatgtgaattttttagaattttttactatttcttacatttgaataaatttttgtatgaattctatagtagtaatatgatattataggatcataaaaagtactatcaaaatcataaaaaggaataaagaaactcaactaaacattttaaacatttttattggagatgttctaagatctctattacattatcttttatattaattactttttactaaaatactctcgattattttgcatatattcaataaaaaataataaataagtttcattgtacactgtaacactaaattataattatttcatgaatttacaatttgaattttttccggaattttatcataacaatttttaactttgctaattttaccgatctattaatattattaaatgtgtaatgacattttgacatgtcctcagaaacaatttaaaatacaacgttgtttggtaacaaattaaacaattgtgattttgcaaaaaaagataataaaaaatgacagttgttttgttttagtatctagtttttcagggacacatcaacccatcataacacatttaaagaataggtaaaataagtgaaaattaaaaaatataatgataaaattcatgagaaaagcttagatgataaaaattgtaaaataatgataattggaggatgaaatatacaattatgcctaatagatattcaatattatacattattaagatagtctctcttgcaagcatgagaaaaaggtattagtcacagtaatataaattatcctttaatatatattattgtctggaaatttatgtgttaaatttttttaaacattattcattttgaaacccagagatcgagtataaccataagaaatgctaataacatactattttaaatatacttttttattaataaaaaattattaaaaatcataaaattttgttcgagtcttacgttatatataggaaggaacgtggtagctttgagcgtcccacatcttgtactttcccataatcacccaatagctcaaacatggttttcactaagctttcattaattcgtctgattctctgttcactcctaagcctccattcctcccaagttttcacgttttcttcttttgcttttgctggcatcactgcttatgaagggacggaagcaagtactctacttgagtggagagctagccttgacaaccaaagccaagcttctctgtcttcatgggcaattggtgtcagtccttgcaggtggaaaggaatcgtttgtaacgaatccatcgctgtgaccgctataaatgttgcaaatcttgggctaaaaggtactcttcactctctcaacttctcttcctttcccaagctgctaactctggatattagttacaacagttttagtggaactattcctcagcaaattgctaacttgtccagactttctcagttgataatggatgataatctttttaatggctcaatccctatctccatgatgaagttggctagcttgtcattgctaaacttagcaagcaatgaactttctggctacattcctaaggagattggacaattggggagattgaagtatttattacttggatcaaataaactttctggtaccattcctccaacaattggaatgttggccaacctcgttgaacttaatctgtcaagtaactctatctctggtaaaattccttcaattaaaaacttgacaaatttagaaagccttaagctctcagacaatagtctttctggccccattccaccctacataggagacttggtcaatttgattgttttcgaaatcgatcaaaataaaatttcaggattaattccttccagtattggaaacttgacaaagctggtcaatatgactattggcgataacatgatttctggatcaattcctacctccattggaaactttgtcaatctaacgatcttagacctttctgacaacaaattttccggagttattccttccacctttggaaatttgacaaagctcacctattttcttttgtttaataacacacttcatggtagattaccacccgcaatgaataacctcaccaatttcatatcgttacaactatctagaaacagtttcactggccctttgccgcaacaaatttgccttggtggttcacttagcaaatttgctgctcactctaattatttcacgggtccagttccaaaaagcctgaaaaattgctccagtcttactagactcagactagatggaaaccagatgtccggaaatatatcagatgtttttggtgtatatccagagttggactacgttgatctgagtagcaataattttcatggccacatttcaccaaactgggcaaagtgtcctgttctcacaagccttaagatgtccaacaacaatttatctggtggtataccactagaacttggccaggcgcccaagttacagagacttttcttgtcttcaaatcatctaacaggaaaaattccagaagaacttggaaaattgacctctttgttggagctatcaataggcgacaatgaacttttgggtaacattcctacagaaataggagacttgtccggccttacaagactcgagcttgcagcaaataatttaagtggcccaattccaaaacaggtgggagagttgcgcaagttactttacttgaacttgagcaagaatgaattcacagaaagcattccttcagaatttaacgaattgcaatctcttcaagatcttgatcttagttggaatttgttaaacggaaaaataccagcagaacttgcaactttgcaaagattggaaacactaaacctctcacacaacaatctctctggagccattcctgattttaagaatagcttggcaaatgttgacatatctaataaccaattggagggttcaattcctaacattccagcctttcttaatgcttcatttgatgcattgaaaaataataaaggcttgtgtggaaatgcctccggtttggtgccttgccacacgcaacctcatggtaaaatgaaaagaaatatcatcatgttggcattactcctttctttcggcgctctatttctattattattggtggttggaatttcgttatgtatttgctaccgaagagcaacaaaggccaaaaaggaggaggataaagaagaaaaaagtgaggatcattattccctttggagttatgatggaaaaatagtgtatgaagatattatggaagccacagaggggtttgatgacaaatatctcattggagaagggggaactgcatctgtctataaggcaaaattaccctcaggacagattgttgctgtgaaaaaacttcatgctgcacccaacgaggaaacacccgattcaaaagctttttcaactgaggttaaagccttggccgaaatcaagcaccgtaacattgtgaagtcacttggctattgtttacatccacgcttctcctttttggtttatgagttcatagagggtggtagcttggataaagtactaaccgatgatacgcgtgcaacaatgtttgattgggaaaggagggtgaaggttgttaaaggtgtggcaagtgctttgtaccatatgcatcatggttgctttcctcctattgttcaccgtgacatatcaagcaagaatgttcttatagatttggattatgatgcccgcatctctgacttcggaacagctaaaattctgaatcctgattcacaaaatataacagcgtttgcaggcacatatggatattctgcaccaggttaggccatttttgctcttaagaatttaatcctatatatatacttgtttcaataataagtcctgctacttgttttataatactatttatattattttgatgaattacagagcttgcttataccatggaagtgaatgagaaatgtgatgtcttcagtttcggagtgctttgtttggaaataataatgggaaagcatccaggagatctcatttctgcattgttttcatcatctgcgtctaatttgctattaattcatgtgttggaccagcgactacctcagccagtgaagccaattgttgaagaagtgatcttgattgcaaaattaacatttgcttgcttaagtgagaatccacgctttcgcccaactatggaacaagtgcataacgagtttgtgatgccaaaatcatcttctttggatccactccccatgatcacacttggtcaactatgtaaataattgaaacttgttttctggtgtgttctatgttttttagttttttggtgtacactgtaattaagcttttcgtgatattaatgtttttctcgagcatgttttgtatgtttctgagggagtgctttgtatgtttcttctgttctttaaagacttggaaaataatggaaagtcgcttatgtcttttgtaagatcaaataaataaagtgtgattttgaagggagcagtcatgtttttggtctttataaaataaataaagtcattatatatatatatatatatatatatatatatatatatatatatatatatatatataaaagctactttatcaaaagaaaaaagtaatgtttttggtaagataaggatattttgactgcatatttctttgagaattatttgacgttaacggttagccactcgatgaagtatattgcatttaattgaagacacaccaaagttccattatatattaggactttagtaatctacaagaaaactcgtataaagatattttgaagaataaatttgaatacaaatgttatatattttaattttacacagaactattatacggatcattttatttttttcaaatagaaaaaaattaagattatttatgactgatatttgcaacaaagtttaatcaattaaatattttattaaatcaaatgtcaattgattaaaatgtttatttttataaataatgttctattatgaattttaataaaaaaatgttatatgaaatttacataaaatgagacattaattaaattaaattaaattagtttgattggttcaaaattaaaagctttattcattgttataaaatataagaaattaatatatttaagagactaaaaacatatttcagattaatatatttgtaaaaacaagaaagacaataaaaatattttagtaaaattgatttctaataaatactatgatattggagtgattatttttcttagtttatgtggaaaaaaaattatccctaccctattatacatgccatctcgcagttgttacaaaaggaagacgttcctcacaaaaaaaaaaagaaaaagaaaaaaaaaaggaagtcgtttctttggatccaccaaaagaaagaaagaaagaagtcgtcttttgataaatcaatctacgagtttctgtaccttgttcaaccaatcaatataaaaaaaatatttctctatttgaaaaaaaatttgacaaaagaacctaaataatacaaattaaataaaagattataaatttggaactgttttgaaattatttactaatctggggcagttgatcacgtccaaaattggacatgaccggtcccgtctgaatctgggcgtgaccggtcacgttcaattttggacgtgaccaaatccgtctttaaattcgtcgttaaatcagttagcgaccgatttcgcgacggaaaatttgattttttaattttttgtttgcgaccaaaatattccgtcgcaaaaattgttagtgactgaaataaaaaccaaaattgacgtgttttgatttttgacgtaaaatatcatttaatatcatttatttttatttaatttgaaaatatttttagactgatcttcatcacagatatgatattttttacttttatttaatattgttttatttagtatatttttttaattttatatgattttatttaatatattctggatttttggtatatataatttttaatatattattttatttaatataatttctaaatttttatatgatgttgtttgatattttttggattttgtatatataactaatttttaataaaatattttattcaataaaaaacttttcaattttatttttgaattcgaaaaaattgaatattttttgatacttctcattttttatatcgagattgacctcattaaacacattattctcatcactctcatcatctctttcatcctctcataatttgataattctctttcaaaaaaaatagaagacaatttcccttttctctttttgttccagtcaaaagcacgcagtcgattaacccgtcatcgaaactacactgaaactcagactttctgtcaattggcgactcaattgtataaaattagtgtggccaaaacatatacatccaagcgagaaagggaattagaaaggatcgtccatttttcatgatgaatgattaattgtgcgagtaagttggtcactatctttatctctctgggtaagcgcaatgcaattctttgcatttcaatttgattcactttgtctcacgcagttccactcctatttctagagttctgcaatgtttccccgctccaagtgcgctttggaattaatggggtgctacaattccgattattgtgtggtgagtgcactttgggatgagtggaacgaggggtaaagtgtgaaatgagtgcggaaaggttaggaatgaatgtgttttgggataaatgaggttattatataaaaatccaaaaaaaattaaacaaaaccatataaaatttagaatatcgaaaaaagttacaacggcgtacgatatgtccttcaaatggtctaacttttgatagaaatgtccgatcgaggtgtacaatatgtcaaaatgcttgaaattgatagaagtaatgaaaaaaaataaaaaaataacatgcaattaaccgactaaataattaaaaaattagaaaacaagaaaattttgggatgttcgaagattaaatcacaattttgaggcaattagaagccttttttgggaaaattttttgacgaagttccttttgggacttgtcagcaccttctcctctcaatttcgaacacgtggccagcgatttcgcctcaattggacattccagtcaaaagttatgaccatccgaagtttatatagcatcattgcatctgtgcatgactgacacgtgtcaagaattggtcacgcccagaactaggcatgactggtcacgcccagagccaggcgtgactgcccccctagtcacgcctggctctgggcgtgaccagtcatgcccagttctgggcgtgaccaactaccccagattgctaaatagtttcaaaacagctccaaatacgtaatttttttatttaatttgtattatttgggttcttttgccaaatttctttagcttaaacatgcgtgatgtacatttgtatactattagaatgtgactcttatcaaaccaacttataaaataagattatttttcatttatataatttatattttgtaccatctctgatcaatgtgatatttttttctcaacaataacaaatatattaattgcataaatagtgatatttagatttatatattttcctaaaatatttttagatttgatgtgtggataatatgatatgtaacttttaaatagactctcatattattctaaaatgtggatttaaatttaactaaatcatataatattgacttgtaaagtaaaaattattattcccttatatatttatcttgatattatttttatccaatgtatggcttaattttgttcaatatatatgaggcttcattcttgtttattctatatctaatttcattttatttatttattttcaaaccaaagtggtctgattagggatatttttttctaaagcaattgtctatattttttaaagataaataattccccaaaaaaaataaaatagactaaatcaaatgcaatattttttttttttttttgtgaaacaactagaggaaacccccaagaacactaaaatccgcaagaaaacacggtattacaactttcagcaaaacggcattatacaaaaagaaagggacaaatcaaagaccttaactgcctaatcaaatgcattatttcaacacaggcttctttgctttaagttcacgtacttatctcctttttatttttccacttatataaatagtattaatttagtatttctattttacctctcttttctcttttatcccacactattttttcttaaaatcactataaaaaaaatggaattttcaaaggcaaaattccgtcgctaacatcaaaatcacaaagatatataaatttaattttggaccttatttatctaaaccaaaagcaatttgcgattagaactcaaagaggagtcggacttacacgtccctaattaatccaaaataaacaagaccgtattattgcctgagctagaaattatgggaagatgaagggaagccctgttaagtgttgagagtttcatccttaggatagactttcgtgagtttcacttctggatttgcattatgggaattgtgacagactccttttttctttttcttttttaaatagacgccttcattaatcattatagagctttgtttgacaaagttttatgtttggagaaatttaatactttaaggtttgctctgaatttatccgctaatataaagtacctcttattacaaataatgtacacactatttcgaaaattcttcaagatacatagtgaagtcacacggggaaggattcaagtcttataaaatttatataaaaatgtgtaaagtgaggaagagtgactatcgatgtaccctttactttcactttttattttataatttaaatttttattcacttttaaaaaggcaaagaagaaaaaaaagggaatgcccaagttaatacgattcacactatgatgttcttgtttctactaaactagtaaagtgacccgtatgacaagttttaattttgaaaataaatatatctatattatatataaagttgatgatgcacatcttactaaagagtaaaatgattcagtattttcaacataatcactatattttaaaataataataataaaacttaatatatacattaattaataattttaacttaattataaatttaaatgtaatttttgagaaattctaaattataaaatgatttaatttctaatatgttttttatagttacaacatttttttagtctctataatttaaaatctctcatttttttcttgatagttacaaatttnnnnnnnnnnnnnnnnnnnnnnnnnnnnnnnnnnnnnnnnnnnnnnnnnnnnnnnnnnnnnnnnnnnnnnnnnnnnnnttttaattaatctcgactaatgttatttgaaataaacatgacaaaacttatttaattcatgttcatttcaaattacattaagttataattctagacgataatgacctaaaacatgaaaaatgataattataggactcaaatttaaattacaagggttaataaaaggaaatattgttgcaagggctaaatgggtaattaaacataataaaattatattacaggaaataaatgttatagaaatgtaggtaaattataaataaataaatttagacaaaaaaatnnnnnnnnnnnnnnnnnnnnnnnnnnnnnnnnnnnnnnnnnnnnngttcttataatttattttgttaaatggcccttgtaaaattctttttcttttttctttttgtccttttaattttgttatagttcttgtaacatctagattatttgtttttagtctctatcaaataaatttcaaagaggctaattcaaaatgcaaaaaaaaatattatagagactaaaaatatatacattacaagaactaaagcaaaataacaagaggaacaaaatcaataaaaagaaattccatagaaatctttttgaaaaaacatttttttaaagactaaaacataaaagcaatatattccggaactgaagagatatgtaagccataaatttatatttaacttcattgactaatatgtctattcaatttagtttaacaatcaaaccatatattaatgcttacatgatcgaggaaatcatatttactttggaagatatcctcttcaaccatttgagctagcttgaataacatctagataaatagaaatgagacagctggtaatgtcaccaaatgtttgtcgagatgaacaaatataaatacctataaaccgattacaataagacttattaaaacacgtatgggttaaaaaaaaaggatattttaaattataaacattatattaatattaaatattattaaaatacatatttgaatattaattaataatattagtaacgaaagaataaaattgtttgatgtaacagaactttacaaggttaatgggtgagaattcagaagtgactttttaaactagttattataaaaatcaataattttattataggagataataataaattaatattttacagcataaaatgtatatttcaattttcaattatgacgggtgaagggcaggtaaattcgaactttttttatatcaaattacgtggtttaataaaattatatatattaagtgattttaaaaattatttatcaaagataagtgatttttacttttaacattaattgtaattatatttaatgtagaaaagtgacatttgcaccaacagtggctataattaatgtagaaaaaaataatttttttaaaattggttgtgattataatagatatttaaagtcaaaatcatttatcagataattttcaaaatcatttaatttggtaaaaaaaaaaaaaaaggtaaattctcggctccattaccatcaacggtgtaagaatatgcttctagtttcaagctctttctttgtgtttttggcttccttgtaattttgacttctctattggtagtagtggtggggaaggaggggatggtacagtgtcccgtaaagccactaacagaaaaagaaagtttaaccaaaataaataaatttgagataaaataaaagcttaaagaaatgttttttttattatgagaaacttatgaattttgcagctactccttaacaattttttcttgattattgtcattgaaaaatagactaattttatatttggtccttgaattttttttattttgtatttttttcctaccattacattggttttgttaagtgctccttgaaatatttttttatttgtcttttggcccctaaaatgttttccatcaattggtgacatctgaaattaacaaaatcaatataacaacattgatttaaatataaaataaaatatttttttaaggatcaaaagcttttgtttttattaaggatcaaatataaaattgatgatttttttcaataataaaaaaattatttgagcaaaaaataagatttggcatattacatagtttagtttggatgtaccagatttgtattaccaccgcaccagatcatttggagtagcgttattgtgtactgtgtatagttgtttcaattgttttaaatattaaaagaaataattatataaaatcgaataatcttgttatatatatatatatatatatgttaatacttattttgatggtgtatttaaattaagaattgttcacatcgggaggataccataggaaagacggagtaccttaagattcaactgctccctcttaaatactctctccattgtgttttagataacttttaaatacaattattttttatagttttaacacaactattaaagatatgtaattaatatttcaaattttataaaatatattatgtagcattataatatatcctttattttttttggttaattagatttttattcatttgctatagaacaacaattattcttacctaaaaaaggttagtttcatggaattttttttataaaaaaaatatgtttggttacattttaatatccctttgaatatattttagaattaaaatgatttaaataaaaatacattagaaaagaaattaagagtactttagcatatcattatccttattcccatgaaaaaaaatctcatttccatctcttctcatgggaatggaagtgtaggaaaagtgtgataaaaaaaaagttagtaacatgtaacaaacatgagtatgcaatattttcatgtagcattcttgggaataaacttttatttcgtgaaacaaacataaannnnnnnnnnnnnnnnnnnnnnnnnnnnnnaatatatatatatatatatatatatatatatattaaaagaagtttaactcattattgaatatgaattgattgaatatcatgtgtgaaaataaaaaaaaatgactatctatgttatataatttacacaaagttattgattgaacagtgaaaataaaaaaaataactatcttatgttatataatttacacaaaattatagcatacctggattaaatttatttcaaatagaaaaaaaatgaaaacatttgtaaatcatatttgaatgaaattttaatcaattaaataattaattaaatcaaattaattttaattgattaaaatatatttttcttcaaataatggtctactatgaattttcataaatacaattaaatgaaatttaacaaattaacaaatcagtcaaattaaattaagtaaaaagatactctaattaaacttggtaggataaataaagtattactatattttttgttattatttggtgttaaaaatcattaataattttaaaaaaaaaattaagatgaaaagctgtattaatctaaagttattacgtgacacaatttttgataatatttttttaaaatttttctttgcttaaacatttctgcgattgcagattgaaaaagtaaaattataccttttttcttttcttttcgctttcattttctatgcatgatagtgattcttcgaagccaatgacgattgattcttatccgtgtagcaagtgccgtctgaaaagctaactgtttgtacggcgtgagatgtacatttttcacactgtccgaggctttcgttcgatcttctttattctaaaatctactttcaaaataattcctgaaaagctaactgtttggtttttttttaagtagttttctttattttaatttttttttgaaacaattcctgaaaaacttaaagtaaaataagctaaaatcaaatgcattacttcaacgcatgcttgcttccttgattccaatgagttagagcactcttgcaactccaatatgaatgtaattaagtaattgaagtgctgttggattaattgaaaatcatctagccccttcttattttcaaccgttggaatagtgtgattattatctcaaactcacccaaattgaaccaaattgcaactgattggtttatggtaaagggatgttggactatgcaactccaagagaacctgatcaagttggtgtcttttcaagtttggtacagatatggtgggaagattgtattgaatggcaaattatacaaatctttcaaatatttagtcttaacctttttaaacttcaccccactgtgactcatgtttgatttgtctatatcaaacccatcttagataaagactaagtatcataaaaccagcaaaaaatcttaacaaatctgccacttcctactggtttagttattccaacaatctctaaaataaaaaaggccatgatcctcaacaaggtactattgaatatacaatgagcatatttcataagcaaaaaaagcgtgaaacagaacgtatacagaaacaaggcaaccgtccctgttcctgtcccaaaataaacaagatttgacctataaaataacaccatttaacaataatatgcatactgcttgggcttttttatcaaaagggggtaaaaattttatgtaattacgttttgggggtaaaaatatttttatttctcaaatagggataagtcgtaatattttttacgactttataaccagaagtcgtaaaaaatattacgactcatatcttttagtttgttaagattaaattataatagaagtcgtaaatatgtttacgactttgaagtcgtaaatatgtttacaactttgaagtcgtaaatatatttacgacttcaaaaaagttgtaaaagcattaaaagatttacgttaatagtttttttaaatgtaattaaataatttatttgaaataattatttatttaatttaatataatttaaaagcatcaaaaaaatttaaaattgttattaatttaataaatttttttattatttgagcaatattaaaagataaataaatttatttaaaaatacattgttatataaaataagagatatatttatttattttgctaataaattatgtacaacaactgtggatattcttttttattgttaatatagatagattttaaattgttaaatacataaataaaagaaaataataaacagttgtttaacagttagtaaaatggaaaaaaaattataacaaagaaaattatattaaaatttgagaaaaatattaaattaaacagttaaataatttaataaatatacaatttataatatgtgaagtaatgatatttaattttttttatgtttataaattaaataatggtaattttttttatattaactttattagtttttaaattaattttgtaattgatattagtaattttgaatttgtaagttgatagaaatattgtttgataatttttttgttatatgagatatagttaaattttttaaaaaatatgcaagtaaaaaaaattgtttcaaaatgaaaatttaatttaataaattaaaaaaaaaatgaagtcgtggagggtcacacgactttgaagtcgtggacctccacacgacttctggttttatttaaaaaacattaaagaaaaaacagaaaaatggaaaaaaaatttaaaaaactatatttaaatttcaaaaaaatattatttaaatttcaaaaaaatattaaatcagacagttaaataatttaataaatatataattgaaattattataatatatgaaataatgatatttaattttttattgtatataaattaaattattataattttttttacgagtaaatttgtttttatatgaaataagagatatatttatttatttgaatttatttattgttttggtaaatatcattatattaattgatgcattatataatatctcacgtgaaatgatcaattaatatatcaaatgatcaattaatataatgatatttaccaaaacaataaataaattcaaataaataaatatatctcttatttcatataaaaataaatttactcgtaaaaaaaaattataataatttaatttatatacaataaaaaattaaatatcattacttcatatattataataatttcaattatatatttattaaattatttaactgtctgatttaatatttttttgaaatttaaataatatttttttgaaatttaaatatagttttttaaattttttttccatttttctgttttttctttaatgttttttaaataaagccagaagtcgtgtggaggtccacgacttcaaagtcgtgtgaccctccacgacttcattttttttttttaatttattaaattaaattttcatttttaaacaattttttttacttgcatattttttaaaaaatttaactatatctcatataacaaaaaaattatcaaacaatatttctatcaacttacaaattcaaaattactaatatcaattacaaaattaatttaaaaactaataaaattaatataaaaaaattaccattatttaatttataaacataaaaaaaattaaatatcattacttcacatattataaattgtatatttattaaattatttaactgtttaatttaatatttttctcaaattttaatataattttctttgttataattttttttccattttactaactgttaaacaactgtttattattttcttttatttatgtatttaacaatttaaaatctatctatattaacaataaaaaagaatatccacagttgttgtacataatttattagcaaaataaataaatatatctcttattttatataacaatgtatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataacaatgtatttttaaataaatttatttatcttttaatattgctcaaataataaaaaaatttattaaattaataacaattttaaatttttttgatgcttttaaattatattaaattaaataaataattatttcaaataaattatttaattacatttgaaaaaactattaacgtaaatcttttaatgcttttacaacttttttgaagtcgtaaacatatttacgatttctattataatttaatcttaacgaactaaaagatatgagtcgtaatattttttacgacttctggttgtaaagtcgtaaaaaatattacgacttacccctatttgagaaataaaaatatttttacccccaaaacgtaattacataaaatttttacccccttttgataaaaaagcctactgcttgaggagacacaaatgaatctaaagtcacatgactatctaaactgatggactgggttaatgtattaggcaatttcattgtaaataactggcatgtgcctagtcatgctgccttgtatgcacgtactggttgtatgcaaccaaggttttaaattacggtcaggtcccgttagagtttcattgcagtatttgatgttgtggctgcgttgattttatactgcaacagaaattgtcattggattttacattttgtttctttaagcattgtttcctgagggaggaggaagctagcaatattctaaaatgtgaaagttgtagttacaaaacaaacaaaagatataaagttagggacggtgcctaagattgaagaagtccacactccacaatgttgtacttgtagacctaaatttcagatgcctgacagactcacgtggttgtttgctttgagcatattccaccctggctgctggcaaatatatgtaaaacttgaattgtgttgttgcctgagattgaaatggaagatagggtcaaggggatgatgtggatgcgatgtttcaccaaactggtggagccctgttatccaacatttttatgaaacccccctgttatccaacgttggtgagtttcacttttggatttgcattatataagagtttgaaaagttttccctttggagagcctcctcttattcgctaatataaaagcctctttcttatcaagaatgtacacattcttgaataaagccttcaagataatagtggaagactaattaaggtcttcaagatatacatagtggaagactaagactcaggcattcagctcttataagtgaaaactaacgtgtaaagtgagaaaggaaacagtattgattgtatcctttaattactttcactctttattttatcactttttaaatttttattcactttttaaaaggaaaattaaaaaaaaaaggaatgccaagttaatgcatttcagacgatgatgttcttatttccttattattttttataataattgctttaaaaatatatatatatatatatatattcttgtccaattatatttttaacgtataaatttataactaaagcataaaaaaatattccaacaagaaaaattaaaaaaaaaagcatatataaaatacttcatctacatttaatcatcattattgtcattaaaaatataaaaataaaaatagtttaaacattattaattccgacatacaacctaagatatcaaaataatttaaaaaacttaattaaaagaaaatagtccatagataagctaaaagacattttcaccatctattcatacataagttacattgtcctatcatataaaagaatttgttataataacttttttttttggaacaagtattaagataatattattaaacaccaaattagaacaagttgtaccaatttaggcgtgaaaccaacaatacacaacgagtacaccagaattgcataactctacttcctcttaattcacatgatatcagggacaaacattattaataactaccaatacgttcctcttaattcacatgacatcaagggtgaacattattgatcaaactgaatagaaagaatggccttgtatctcattctccttcccctagatacacaaagtaatagtatacacacaaagaaagttgcaatgaagaactcagcaaatcatattagttttcaataccaatcccccagctgacaaaggcaaagccatcaatcaaacatgtcggttaatcaaatttttgtttgcacggctctgttgacaccaggggcaattatgtcaggctgaaacagaaaataaagtattgaatgtaagaaaatggaaaagaaaaatatatcatgaagatgaaatgaaatgtagaccttgagtatcaatggttgcactgcattaggacccctggatgagaatccagccacaattggagcaggctttattcctaaatatgttcttgctacagtcatgtaagcaacaagtttcctgcagagaaatttatagattaagtttttcatttgctgcaagtattcttagaatgtaagtaacactgaaatgaaattggcttagtgtctgtttgaattcatgtcagatcatccaaaatgaccttgaaataccaactttcctgattttaaataaatatgtacatgcttggtctcccgttggaaaattgattctgaatcccaaattaaacaatttatccggtggtaaaccgccagagcttggccaggcacccaaattacaacaacttcaactctcttcaaataatataagtggaaaaagtccaaaaggttttcgtaaattgaccctgttgtttgaactctctttgagtcacaatgaattttctaactacattcccacagaaatgggatctttgctaaaccttcaacatttgaaacttgcagcaaatagtctaactggtccaattccaaatcaacttggacgactgctcaagttaattgacttgaatttggcgataataaattatcacatggccttccctctggatttaactaattgcagtctcttcaaactcttgatctttgtggcaacttgttaaatggacaaataccagatcactcggaaagttgcacagattggaaaatttgaatctctcacgcaataatctctggcaccattccttccaatttttaagaaattgttgagtttgacaaatgtttacaccaacaactaattagagggtccaattcctgataatgttgaaggtaacggctatggtactgctaagggaggctccccaagagcaagcgttgtggcctacaaagcgtgctggcataaactggataccagagggtgccatgaagcagatattctacaagcatttgattatgccatatatgatggtgttgatgtcatctctgcttctcttggttcatctaatccctataccgaagctttgttaacagatgggatatccataggggcattccatgcagttgccatgaacatagtcgttgtttcctctgctgggaatgaagggccatcacctttaagtgtcacaaatgttgcaccctggtccttcaccgttgctgccagcacaatagacagggattttctcagcgacatttctctcagcaacaatccatccattacggtatcatctttctatatttttccgtaatttatcaattagtttcatatgtttttattatgtcaacttaattaattggaatgtgtgtgtatatatcagggtgccagtcttaatcgaggcttgccaccatcgtcaccgtcgaacaagttctatcccataattaattctgttgcggctagacttcctcatgtgtctattaatgatgcgtaagcacaatttttgtttttatttcccaagcttgcttcaaatatttatatgtacttgtcgcatacgtgtgtatgtatgtatgtttgttggtgtagtcgtctttgcaaagcgggaacacttgatcctagaaaagtaagggggaatatactagtatgccttcgaggtgataaattaacttcagttagtgagggccaacagggtgctcttgctggtgctgtggcagtttttgtgcaaaatgatgagcaaagtggaaatttacttctggtcgagaatcatgtattacctgctgcaacccataatgaaagtccagcagatgctgtcaagtttaaacatcagcagcaagtaattaaagttcatatatatatatatatatatatatatatatataaacacttaattaatttctacatgtattgttgcaggggggtattaacttgcttgagagcggcaagaacatatataggagtaaagccagctccaataatagctggattctcatccaggggtcccagttccgtgcaaacattgatactaaaggtctaaatacattttgttacaccaacatgacatgatgattttcgttcttacaattaatgactcatgtaagataaacttgccgtaatgtgtttctttttcagccagacataaatgttcctgttgtgaacataattgcagcttttacactaggagcaggtccgtctaatattgcatcagatagacgtcgatctcttttcaatgtgccacatggaacttctatggcttgttctcatgtcgctggcatcacgggtcttctcaaaacatatcatcctacttggagtccagcagctataaaatcagctattatgaccattggtactaataattgctatttatatgtaaattctcaatttaaattatataataatttttttcttcttttaatattttttttgaaatatataaatttagttttttttaacttttatccaataaatattaaaattaattgatttttagtgtattgattgtattttttatataattacacattaaaaatttgaaagatgaattgagaatatggacttagtgtatcaccaatataaaaaaaagttcaattaagtaagttttgattgtaaaaaggggagcataggaaaatcatcgaaaatcagaaatctaagacacaaagaagagaaaaattcacactgaaaaagttaacttatatctcttatttaatgggtcttcttgcattttctttcattaattattttttccttttatttttgtaagtctctctgacaaagaaagactaaattctacttggagtcgaactatcaaatcagctattgtgaccataggtacattaatattagctatagtaatatatatgcatttttaattacaaaatactatcatatgtatgcagcatatcatttggaaaaacattggaggcttattaattaacaactatgctttttatttatttcagctacaacattagataacacgaatcaaccaattcggaatgcatttgataagaaagcaacccccttcgaatacggcgccggacaaattcagcctaaccttgcaattggccctggactcgtttacgatttacgcaccaccgattacttgaacttcttatgtgcttctggttacaaccaagctttagtcaagttgtttgccaatttgaaattcccttatacttttcccaagtcttacagaattgaagatttcaacaatccttcaattacggtgcatcatcctggctcaaagactattactgttacttgtacagttagaaatgttgggcctccaagcacgtatgttgtgaatactcactggccgaagggtattaaggttcttgtccaaccaagttcgttgacttttaagaaaaagaagtttcaggttattcttcaggcaatattaattggtgtgcctagtcacaacattcctttatttgggaatttgtcttggacagatggtaggcacagagtaaccagtcttgttgtaaggctgtaatgtaaccttagaagttagaagttgctctcagcattgttatggtatcactgtcatttgagtgtgtttgcattttctttttttagggtgtaatataagggtgtttcctactcctgttgtattaaaactttttctaaactaataggcaggtttaaaattttgaggtattgaactttgttgcattggagctatgttcacactctatcatgtatggaacctgtatctttgaaagtctaataggcattgtttagagttgagacccatatctaaataatattgaacaattttaattaggctctaaatctatcaatttgccttcaccgttgatttctcttctttctattttatctcgtgcaggcatgcattcatcttcacctacctttagtgttagctgttggtcccagatgaacttaagagggatgaattgagttttataaaataatttataatttaaaatcaaacttaaagcaataatatagagataagagataaataagacacaatcaattttaacatggaaaactcaattaggtaaaaaatcacgacgtccaaattggataatcaatccaatggacaacttcactatgataattttgtgtataagagtttctatcctagtttcatagtctacccttatacaataattatctcagttggtatccttgtcttatctcaattcactaagaatagagacagactaatatctttgttttctagtcaggctggtacctagtttctccgccagaagtcgcacgtttcaattcaccaagaatggagacagaactagtatcctagttttccaagtgcgacctcttccaaagtcaagaagaagaatacaataaaatggttacgcttctataccttaagtaaataggtacctttaaatcctgatggagagttgaagaatcagacttgaggaacgcttctatatgatctcacaacaattctctcaatgatgcaaatataaactctttaaagctctaatattatttggaagggaatgcatactctacacaaaaatatgtttcgatttatgctaatttaatcatatgattttaaccaattttttaatgcaatcctaaaaaatattctatcatattatgtaatgcaatattaattaaagatattctattatattatgcaatgcaatcttaaaaatattctatcctatttttgaatgcaataccaaaaatatattatattttatttttgaatgcaatcttaaaaaatattttattttattattcaatgcaatcttaaagcaaatatcttgacaagatcaatattctaatctccttacataaaatttaataaaaataaatagaaataaatcttcttaattccatgtcatcttgaatgatatcaatcttcaaaattctttaaataattttttcaattatgttgatcttcataaatccaaaatatcagtaacttcaaaatatgaaataatcaaataattatcatcagtgcaataaatttaataatgtgacattcattgtttgttatcatcaaaactttataaatttttttatgcattaggggtttaacaaatatccaacaatttctccctttttgatggtgacaaataatttatgtcatgtactaattaaatgaacatatatactatggatgcattatgaatgaaagatattcaactttatctactaatgattttcaactattctctagttttgctaagctatgactagaatcaataactcacaacaatctaccataacatggcattcaaacatcttcccctcttttggcatcatcgaaaagattaaaacaaataatcgtgatagagaaaatgattaggaaccttagcatgaatagggatacatggggagaacaacatgaatagagctaacaatgaagaacaagaaagtgataaagatgaaagacggcaaagaaattaacattctaaaacacatgccttaatattgtaataaattatcttttcgttcatatttaggatcactctatgttcttattctcaaggcttttcataagcttgtacatcatgactgttctccactcttagtatggaaatatttcataagtcatcaaatctccactcttagtatgaaaatatttcctaagtcattaaatcaataggtctttataagcttgtaacgtacaaggtagataagaaatacacaaagaataaagtgagataggaaacaaataagtatagtactgatatgcatagttttccattttcctctccacttaatactgtcaacatgccttttttttttttttaaatannnnnnnnnnnnnnnnnnnnnnnnnnnnnnnttaatcaacatgattgcttcaactttcttttttttttcttttttcttttctttgttctttgctttagaaactatgcatacccacacctaaaaggaattgtttaatcaaaacacaaagggttgcatattgtgactagggatataaaatactgaaatgattaacttgaaaggctcaaacaaccaaagatgacctatatcattttcaataaacttatgaaacatcttaaacaatgagccttgaacttcaatgatacaagttctagattgtctgtctcacagagaaaatacacatgcacattattcttcacaatatagaaaatttattataatagacatgcacttaagaattaataacacaagaagatatatgaagtaaacgatgtaacatagatagatgaatatagaaatgagagaaacaagataatccaatatcaattaaacaaacgttattagaattggtcttcttttatgtaagacttgttctttttataagccagaaaaaataataaatatataaaaatgacgttcccaatttcttaacatcaaaataaaataaaaataaaaataattcaagtgagaaatcgggtttaagaggtcaagttctctctacgtgaacagtaatggcgctagctgtatgtataaataatctggagggatattatttgagtaattattttttattttgtattatttgagtaaaaaaattgattgaatgatttcttatttattgatggtatacaaatctttatttatctgcaaaagaatctttatttacataaatatatttgttaacgttttacatgaattttttttcctcaatttgtatttataaaaattaaaaaatgtcacttttttcttttttaaaagaataataaacataattaatgtataactataatttacaagtggggaccacaattttttttttggatttggatgcattaactttacacaggaggaaaagtcagtatcactttcattaatcttataatccaaattttacaacttgttttaaaagatattttttaatttattttttactttagttattaagttatcactttttactttaaacccataaaaaatactactaagtgtgtagattaattgttaccaggtatttcggtatagcacatggtttggaggagaaaatttattgcctataaactatataagggtctatctacttcaagcatgattacatttgattatatttgatgaaacataccaatggtctagataaaaaaaaatgtgagaaattttgtagcagtactgctagaaatttctttaaccgtcttatatttgtcaaacattttatctgacaattttctaaatgatataaaagactattaattaaactgaaataatcttgtattaattaataattattctatatctttaataatgtttttatggttttaaaatatacaagatataaaaattaaattaataatcaaattagaaatatctttcaaaacaaagtggtaaaattcgaactatcaaattaatctattattttaaaatgagattaagtaattgtaaaattcccaataaatctaatccatgctttctaaggccacgctaggtattaggtacgtaatttcacattaatattttttctgctatttcattgcactactagctatgatcgaggatccatcatcttctgctattccataatcacccaatagctcaaatatgatgttctctaagctttcaataattcgtctaattctctgttcactcttaagcctccattcctcccaacttttcacgtttacttcttttgcctttgctgccatcactgctgaaaatcaagagagggaagcagctgctctacttgagtggagagtgagtcttgacaaccaaagccaagcttctttgtcatcatggtccagtgctgtaagtccttgcaagtggaaaggaatcatttgtgacgaatccaactctgtgaccgctacatatgtggcaaatcttgggctaaaaggtactcttcacagtctcaaattttcatcttttcccaagctgctaactctggatatttgtaacaacagttttaatggaatcattcctcagcaaatttataacttgtctagagtttctcagttgaaaatggatgctaatctttttagtggttcgatccccatttccatgatgaagttggctagcttgtctttgctagacttaacaggcaataaactttctggtaccattccatcaattagaaacttgacaaatttataacacttaagctcgcaaacaatagtctctctggtcccatcccaccctacataggagagttggtgaatttgaaagttggtgattttgagagtaatagaatttcaggatcaattccttcaaatattggaaacttgacaaagctcgacatggtattcttagccgataacatgatctctggatccgttcccacctccattggaaacttgatcaatctagagtcgctggacctttctaggaacactatttccggtgttattccttctgcccttggaaatttgacaaagctcaattttttccttgtgtttaataacaaacttcatggtacattaccaccagcgttgaataactttaccaaacttcaaagcttacaactatctacaaatcgtttcaccggtcctttgccacaacaaatttgcatagaagggtcactgagaaaatttgctgctaatggtaattctttcaccggtccagttccaaaaagcctgaaaaattgcccagtcttaccagagtaaacatatcaggaaaatgcttgagcggaaatgtctcagattgcttttagtgtgtatccagagttatttttaaaagcatttctaaaagtagaaaataagaagaaaaaaaatgaaatgaaattttatataagtaaaaataagttttctcttagttaatttttagaagctcaccaatgtaacttctttaaaagatgagacgacatctacatatgaattaataaaaactcattttagcttatgaaaaaacttatttcatttttttcttcttacattctttttctagaagtgtttctagagaaatttacatccaaacaggtccttcgttgagctgagtagcaatagtttttatggccacatttcaccaaactgggcaaagtgtcctagtctcacaagccttaggatatccaacaacaatttacctggtggtataccaccagaactagaccgagcacccatgttaaaggaacttgtcttgtcttcaaatcatctaacacgaaatattccaaaagaacttgggaacttgacctctttttggcaacattcttaccgaaataggtgctttgtaccgccttggaaatttggagcctgcagcaaataatttcggtggaccaattccaaaacaggtgggatctttactcaaataggttcacttgaacttgagcaacaacaaattcacagagagcattccttcgtttaaccaattgcaatctcttcaagatcttgaccttagtaggaatttgttaaatggaaaataccagcagaacttgcaactttgcaaagattggaaacactaaacctctcacacaacaatctctctggagccattcctgattttaagaatagcttgcaaaatgttgacatatctaacaaccaattagagggttcaattcctaacattacagcctttcttaatgcttcatttgatgcattgaaaagtaataaaggcttgtgtggaaatgcctccggtttggtgccttgccacaccctacctcatggtaaaatgaaaagaaatgtcatcatgttggcattactccttgctttcggtgctttatttcatcaaagagcaacaaaggccaaaaaggaggaggctaaagaagaacaaaccgaggattatttttccatttggagttatgatggaaaattagtgtatgaaagtatcattgaagccacagaggggtttgatgacaaatatctcattggagaagatgggtctgcatctgtttataaggcaaaattaccctcgggagagattgttgctgtgaaaaaactacatgctgtacccaacgaggaaacactcaacataagagcttttacaagtgaggttcaagcctcggcagaaatcaagcatcgtaacattgtgaagttaattggatattgtttacatcctggcttctcctttttggtttatgagttcctagagggaggtagcttggataaagtactaaacaatgataaccgtttgattgggaaaggagggtgaaggttgttaaaggtgtggcaaatgctttgtaccatatgcatcatggctgctttcctcctattgttcatcgtgacatatcaagcaagaatgttcttatagatttggattatgaagcccgagtctctgactttggagcagctaaaattctgaagcccgattgacaaaatttaacctcgtttgcaggcacctatgggtatgctgcaccaggttaggtcctttttgttattaagaaatcaacgctatacttgtttcaataataagtgctgccacttgttgtatgatactattttcatatttaatttgatatattacagagcttgcttatactatggaagtgaacgagaagtgtgatgtcttcagtttcggagttctttgtttggaaatgatgatggggaagcatccaggagatctcatctcttcatttttttcatccactggaacgtcatcagcttctaatttgctgttaaaagatgtgctggaccaacatgtgtataacgagtttgtgatgccaacatcatcttcagtgaatttattctccatggtcacactttgccaactcgtagataattgaaccttcttgtttcctgcatgttgtaagcttttttattgctttaaatagtgaagaatctcagcacggtttaccggagactgaatgtagatcagtaatgatcagaacagaataacttctgtctcacattctctttattcctcaactcactgtgttgttgttatacataatgtttcttgatttctatatgctgtaatcgtgttagaatcatataagttgcattagatttacattggctatactctctatatctcaattacacaattacataatctaattgtgtctataagttttcaagaaaataattttgggactgattttgagaaattcagttctccctttctttggatattttaccatttgtctaatacatatattcaaattcatatattcttcaaaatatccatataggagttttcttgcagatatatttagccatagtcctaaaaaatatttacttgaagagttttccgtttgtaaacgagttcaaccttgttattttattccgttaattctgtaactattataatcgattattgtttcaattaatcaattaaactatccaacaaaacatctaggttaacattcagatcaatgtaatcaattattactgaacgagtatttagaaactagtatccaagcaaagcaaccaattatgttaaatggtaattgattattgcctaatctactgctttatacaaaaactagttgctgtggtatcacatgtcctcacacatactggtgcactcacacaaatatacaataatttctctggtagaatacttctgatgtatttagataatggtctgtcaagccacacattggtcttttacatgatatgctatttataagtaatagtaactcttcacctaaggacatgactctacacatgagtaacttcttcacctagggacatgactcttcacatatctaatttattattattaaaatttaatccaacaaaatccccccataaactttaaatatttcttccatctttcatccccaacatcttcttacaattttccagcagcaatgttggtaatggctttgtgaaaacatctccgacttttgaaatggactcctagcatgcttgcttagcacacattctttacaaaatctcttttcacagttcaaactcggcaacccatccaccattttcttgttcatcaactcggccaggcctccgtagtgaagatgcccaaaccggcgatgccataaagatacttcatcactcatctcggtttgcaaacagtcgacctgcacactcctcaacattagtttgaacattctatttttctccatctgaactcgaactatcaaacgtccttgtttatctttcaagaggataactcggtctgtcatgagaactaggggtgttcatcaaccaatccaaaccgatgcaaaccgcggtgaccaaaccgataaccgaaaatcgaaaaatcgaaaaccgaaaaaaaaccgaaaattttcaccggattggatcggttttcggattgactggtaaaaaccgatccaatccaaaccgatccaattacctacttaggctttttagttttacatttaagttatgagttcaatttgaaaattagaaaattgtgtttgtttttgttcaatgaacatgtttgcaataaggtttcactgttctttattttgtccaatgaacgtgtttgtccaatgaaaattagaaaatggtgtttacttttgtccaatgaatgtgtttgtttatgctagatactccttattttgataaaaataagtctctaagttttatttttagacattttaaaaaaccgaaaaccgatccaatccaaaccgaaaaaaattagattggattggatcgaatttgaaaaaaaatcaaaccgaatggatgatcaaatgaccaaaccgaagggattggatcggatgattttttgcttcaaaactgatccaatctaaactgcgaacacccctaatgagaaccgagtagtcattctccatcagttgtcccacactaagaatattattttttagatcgggcaagtaatagacatctcggatgcgcccaattcgtccatctttctacaagaaacaaattgtacatcggcctttgacatcaacctttgaagcatctccaaacgaaacatgtgcggtttctatttgtctcagattactgaacaaatgtttatgcccacacatatgattgcttgcaccagtgtctagataccattccatctcggatgtctggttgacttcacttttagtcatcatcagaattcatccatctcttacttctccttctgtaacaaggtttgaagtttcatttcttctttcatctcgacaatccttcgcaaaatgtctaactcgaccacagttgtaacatctgtccgagttgcaatctctcgagtaatgtccatactttccgcatttaaaacattctacattcgattgatttgaatgtcagcttcttccacgacctcggcctcgccaattctgccgacttgattcagcctgctccttattccttccttcttgacctcgacctctaccacctcggtcatgtccacatccacgtcggccacgacctctatctcgaaaattgtgagaatagagcgctttctcgtctttgattgaagcttttgtctggagtgcttgctccagtgactcttctttcttctttttctttctttgttcatgtgcctccaaggaaccagcaagttcgtcaacggtgagcgttgctagatcctttgactcctcaattgcacatacaacattctcgaagtcgtcagtaagagacctcagaattttctccaccactctggcatcggacaacacctctccatttctgtttagttgatttaccatggtctggacccaggtgatgaaaccggataactccttccttcattttcattccttccaactctccacggagagtttgaagtcgaacctgtctaactcgatcggctcccttgtagacatttgcaagaatgtcccacgcttcctttgaagttgttgcaccagcgatcttctcaaacccggaatcatcaacagcccggaataacatgtacaacgctcctttgtctttcaacgtcatctcctttaatgtcttgttctgcgccgtcgtatatcctgttgtggatgttggttccttgaaaccaccatggacaacctcccaactatcatgggctcctaaaagagctttcatttggatactccagttttcgtaattagtctttgtaaggcggggtagtgacagactactacttggtccactctccattttctcacgctctgataccaatttgtggtatcacaggttctcacgcacacactggtgtactcacacaaacacaaaacattttctctggtagaatatttctgatgtatttagataatgatctgtcaagtcacacattggccttttatatgagatgctgtttataaataatagtaactctacctaagaacatgactcttcacatgagtaacttcttcatctaaaaacatgactcttcacatatctaatttattattattaaaatttaatccacaagttacaaaggtgttagttttgctggtacaagaagtttatatgaaatcagaaccgtgagaagtatttcattcatacagcagcaaaatgttatgtttctgatccatatactgacagaatagcacagcagatatctactacctaacaggttagtgagccacctgtccaacataaatacaaagcttaagacactccaaaaggtataggtggttttaccttagtctgaagatacattaattactgcataaaatattaacagttttcaaccatcaaattaacaagattctttgatttaatgatccatacatagaaaaaactcatttaatgctagataccatgcagaaagtgggactaatatgccatgtagttagtactttgtttctagagagaggaatgaactagccaaattctaaaatgttagataccctgtctacaaattttgtggcagtttccccaaaactacatcatgcatatatattgcggtccgcactatacaatttgtacatttaaatttcacgtgcaactttggccccttcgacgctggttgtttctggattcaggaaattacgagttataaatatatatatatatatatatatatatatatatagaattaacttaatgattatatatttttattttaattttatattttgaataagatattattatattaaaaattttaaaataataaactgattatatttattaatcaatattatgtttattctaatttatgttttatttaagtatttattataatattatgtttacaataattaaaaaatagaaaaagataaaaattaaaatatattttgattaaataatcatttttatctctaaatatgtagagtactaacaaatttatcaatgaatatgtcacgtaaactctttcgttaataataatatgtgaaattaacaaatgaataaatttgtcacatattttttttcacttttaaaactaaaatttaaattttcatattttataaatgaatttattgcgttctacacattaaaaataaaaataattatctaccctaacgataataataatgataaaagtatcaaatttgagacacaggaagaaaatcaccaatactgcctttgtctcgtttccaaacacacttttccttactttattccgagtttcctttatgcgctatgcctggcaactttgtttatagtgataatgcactttcttaaagtgaagaaagataatttattttaaattaatcattagcatttcaacatatcattatattataaaataagtctaatttttttctttttcatttttgtaaaaaatgatttaatccttataaaatgtattttttttctataaaatgctttaagtaacatttattttattgttcaaaacatttattttctataaaataaatatattttataaggactaaaaaataccaagaaaaatgaaaaaaaaaactaaactataaataccaaacaagtattttaagcctattttttttatataataaactgagagggacatatgtagaaaaccctgaacaagaataaaggggtaaggcttgacaatgtaaggttttggaagaattttttttattcatctccaatttataaagaaaagggttaatttctacccttttgcttgtttctttttctttttcttttaatatatttctagatctttctaagtaattaagggttgatagactcacactactagattgtaatgtaattgaattttattcttaattcatgttaaaatttgttgtttagttattaaatatccattatcttctcttcagcaatacaattttaaatattcatgctttggctgcaagtatagtgttcctagtaaatttaagaataaatttagttattttaaataaaagtatatgtgaaaaaataattaataaaactcaaaatttttaaagcatcaacaatgttaaaataaaaagataaaataacaatagttatgaaatggaaaaaataatttattgttcataaagatatatgtacataacacccacaaaacttttaaaatttgatgttcttataagcatatgctactttaagaatacttaccaagaacctgttccaataagcatttcttaggatgtgcttaatagaagaagaaaaaaaatatataagtgaaaaatagaatgaatgcaaataagaatgtttgataaaataagtgagaaatacaataaaaataaaattatttgattttagagaaattaaaaaaataattattcatttattttatttttcttcttcttttggttactaattattatattaaatctaagatcttatttaagaatatcaaatttaatattatttaaatcaatgttatgttgattttttttctttttatttctttgaacaagttaatttttattttctaattatttatttctcttcctttttaagtttcaccacatcagcaggcaaaagaacccaaacaatataattctaataaaaaattatcaatttgaggctgtttgtaaactatttacgaatctgggacagtgggtcgcgcccaaaattgggcgtgaccggtcccgcctgaatctgggcgtgaccgttcacgcccaattttgggcgcgactcaccatatggcgacacgtatcataacagatggagcgatgtgtatataaacttcggacggttataacttttgactggaatgtccgattgagacgtagtttgtgtcaaaacgctcgaaattgagaggagaagccctgggcaagttccaaaagggacttcatgaaaaattttccccaaaagaggattctaagtgccttaaaattgcgatttaatcttcgaagtccccaaaaatttattgttttctaattttttaattattttgtcagttaattacatgctattttttttattgtccctcttaatttcgagcgttttgacaaatcgtacacctagatcggacatttccatcaaatgatctacgatatgtccgatcgaggtgtcaaagtccgatcgaggtgtacgatatgtcaaaacgctcgaaattaagagagacaataaaaaaataaaaaataacaggcaattaactgacaaaataattaaaaaaattagaaaacaagaaattttttggggcttcgaagattaaattgcaattttaaggcacttaaaggtctcttttggggaaaatttttgaccaagttccctttggaaaattatttaggacttctctcaattttgagctttttgacacaaattacgccttaatcggacatttcagtcaaaagttatgaccatccaaagtgtatatacgcatcgcttcatctgttatgacacgtgtcgccatctggtgggtcacgcccaaattcagacgagaccggtcacgcccaattttaggtacgactcactaccccaaattcataaatagtttacaaacaacctcaaattgataaataatttataaatatcctcaaattgataattttttttattaaaattatattatttaatttcttttgctcacatcagtgtctcggaaggacttggaggtgctttaatagatgactgttgccctgtttcgctttttacggagcctaatctttttccaccaaaaaaaaaataatattcttattcccccacgtacatgaacaaagtggctaacgcatgcagccttttcgttacacgagtgaatatggaagagaaactaagagtatattaaattattttttatttttaagaacttttaaaataaattatttatataaaatacttagatttaaatttaaaaaatccacaatattaattggattctctctaacaacaaaaaataagaaattgttttttatcttaaaaaattcatcaaacatcttatattgaaaaccaacttagcaaatttcctcttttttgaacggtgatgtggccatagtcaattagtcatttacttatgattatctttggaataactttatcttttctctcctaaaaaactgagacaagattgtgattggagatggagaaggctcgtaggaagagaggtcaagcattcatatattctctgttgttatggtaggtagaagtggtggtggtcactaaaagaaaaaagtatagagtgtttagcaaaagaaaatgaatttgagataacattaaattattttttaaactcaaaataaaattataattaagcaaagtatataatgtatacatattttaattttgatcaaccagatttttatatggttaatcaatagatttctacgtggacatgagtatagtgtgtttgcattaattttatggtgagaattatttaaatttttgttagtaaaagtaaagtaaaaataccctctaaattccaaagtaatactttttttagtcttttggttttgtatcaaaattttaattcttttaacttttttatgatatttttttcacgagatcttatgtttggtaagattcttgaaaaatttataattttttactagtttataagttactttaaagcttgtaattggtacatacacaaacttacctcaagtaatttatttttataagttaaagtaacttatttttcataagttatttaaattaaatttttcataacttacgaaaaataaataaacttacaagtttattattaacttttttttttccttnttgtattcaaaagagacgctaatcatgaaaataaaatttattaggaaacaattttattataatattttttattttttatttcaataaatatattattaagtgtgtcaagataataatatttattaattagatgacagaattaaaattggtcaatatagaatttcttatgacgctaaaacattaatcaatttggtacggaaggagtagtcgtaactcgtaatcagttcttacttttatttattattgtgaataattgaaaaagtatgatttatagaataatttgtgataattgtagttgaaaattgaaaatattttagtctaaatctatgtcaataaaatatttcttaaaagtatgtttggtatgacttttggtattgtgtgttgtatgagaaaattaagaatatgtttaaaaataatattaaagagaaattgtaaattcttttagggaaactcattcattttatattttattttaattttaaaaaattattttatttctattctctttattctgatcttctaaatcaaatatatcataaaataattaaaattgactttctaatctcgaactttgtgcactttaactatttctaatctcgaactttgtgcactttaattcctttgtgttttatctttgtttttttctatttactttgatacctatatctttggttgattaatcaaacagggatttttctttctttttttttttaacctttttaagttattgatttgaaatattttatgaaaagaaggcactttatgcaacgtttgtgctaaaattaagtgggctggaatgtttcacgtgatcgagcactacttttttctcgtacattattaattgttatataatttaacaaaactgctttaaatataaaattcatgcactgtttgtaattacataaacttctgcttaaaatctttacaacaggttagtgactactatcttaaccattaaattatcaaataaatatacgatcaaaaaaattatcaaatcaataaatctattatgtaacttacccattgctgagaaagttattcacttccccatgttagatactcctcctctttctattgttacaaactaatgcgaatgcattgtttggcttatacagaaagacagtatttatatttggtagaaagatagtatttacgtagaaattgaaaataacgtaaaaaaatgataggaagagctgtaagcaggatcttttatcaaaattgtcggtggtgctgttgcaatttgcaataagtaataaataataacagaggtaggaattgatgatgtcactggtctctatataatgaaaataggtaaaagttacttaagatacagagctagacttaccctatgtttggaagaggaaaagataaaaaagaaaatttcaaaaaataaaaaagaaaatttcaaaatttaaattggaggaaaaattaaaaatagaaaagttgtaattttttttcttctaaaagtgggttactctcttgatttttttatatttttttctcaaaccaaataagagaaatacatggtttttttttttctnnnnnnnnnnttttttttttttttttttttgtgaatgacatatggtgattggtgaagagggcgtatgcaaatttcgaaagccaatagtaaagcattatgcgcaaataccttcataaaattctataatatatatatacattctttgcgtcttattttttttttattacatcacattatttactatattttttcaactttatttggtaggatgatatatttatcaataagtaagtatatatacctttcgtaattcatttttcatattaaaatcatgcttctagaaaatggtgaaagcagagttatgttagggagcaatgataacggtatactcttttttcttttagatgcttgtatgaataaaaataataatcactatccacgccacttttaatcaaagttaattagaataaataataaataaatttaataataaatacaaaaaatgaaaaatgaaaggaagggaaaataataggacaaataattacaaaaagattatctataacataaaaataataacatatctaatctttcattagacatattttttttttattttatcctagaacatatcatccataaatttatatcctattctattaagttttatttaactaatttttttcaaataaatttcaatctacttttatctctttttatattaaactcttgatcacatacttttatcgtcaaatatctaaaaaatgtctcattacaaacataaaacacaactcaaaataatagagaggaaaaataaaagaaagagaatgatagatataatatataatagctagtgaacaataaagagagaaagaaaaaaatagaataaaattaagatggaatatatataagcagtggcacaggcatggattacatccacaccaaaacaacaactgaagatatattatggcattctccatcttcaaacatgttctgtcattattctttctatgcattttcttgcaggaacctaccaatgcccttagaaaggctagtaagcttttgccttttagttcccactttgagaatttccaaatttatattttgttaatcaatgtacattaaaatatttcaccaattgtgtgctttgaattctgtgttttcagacctacattgtgtacatgggaggacattctcatggtccagaccctttgccaagtgatcttgaaacagccaccaattcccatcatgatttactcgcttcttacttaggaaggtaaaacaaatgttaaattctgttaaatattattaggacgtacgtgttaattaaaaattgataatttaacagtcatgagaaggccaaggaagcaatgatgtactcgtacaataagcacatcaatggctttgctgccctacttgaaggggaagaagcatcacagattgcaagtgagcaaagactattaccatatattgccatgattttcttgtcatcttgaagccacacaaattgatataataatgaattacatgtttttattggtacagaaaatccaaatgtagtttctattttcttgagcaaagagcacaaattgttaactaccaggtcatgggattttcttggactggaaaaaaatggaaaaattcctgcaaactccgcttggaggaaagcaagatttggagaaaatataatcatcgctaatattgattcaggtatgcttagttaattcagtttacattttttttttcttcatgaatttgtactgcaaacatattttccttttgtaaatacgttacgttgcttcttgaacaggggtttggcccgaacaccccagtttccgcgacaaaggatacggacctgtcccttcaaagtggcgtgggaagggtgtctgtgagatcgacagttttaatggtacaaagagttatctatgtaacaggtaatttttctgttatttcaattcaaaattgttgggttgagcgtgaaataatatatgtattttaaaacggtgtgatgatcacggccatggaaggtagttattattttatttacagcttaattaatgttttatctgtataattttggctcttattttctctctcttgcaattttaattcatttattgtaaataaattcacaattttactctaatctttagttttatacactttttttttgttttaattaattatattagtttttagttgttaaatgtttaattttcaatcctcaatgttagttaaaatgtaaaaaaaagtatgcaaaattaggattaaattaaaattgtgaattttataaaataagaaattaaaattgagatcaaaatattagattatgattcataggctatcaaaattgtaatttagttattctattatattatgtattttgtgtttattaaggatgtgtttgaaacgaaagaaaaactaccaaagtatactagaatactagatggatagaaatataggtgtacttagtatattatatatgtatttttttaaaaaaatagattatagatgaatcaaaattataatttaattattctattacttatttttgtgtttattaaggatgtgtttgaagtaaaggaaagagtgtgaaagtatcctagatggatagaaactatagttttagtcaaataagaacactactttttattattaaaataagtataaaaagtgcaataaagatgacaagttaacatacgaagctcttacacaatgactattgtggtttcatatgaaaaagtctatttttttgtaataaaaaaaaatatatgctctgccctccaaatccatatttcaaatccaaattcagacagggacaataataccccaatcattattccaagagtcacaagaccaaaataaataaatgagtatcataatagcaagcaagcaattttggagtcttcagctcttctaatacacatcgatccacacagagtttaagtatgtacgtattttggattttctttttcataacattatatattttataaaaatttctgatatttttttaagaaaaaatattataaactatttattgctcacgtcaagaaaaattcttgaattcgtcgctgctaattgctatcacatgtagccataatattaatattaatataattatgatgaatattcaggaagttgatcggagcaagaatttttctaaaaaatcgggaggccgaagacaagaagattgagcgacggctacgcagcggacgtgacttcgtagggcatggtacacacacactgtcaactgctggtggtaattttgttcgcggtgcaaatgttgaaggtaacggcaatggtactgctaagggaggctccccaaaagctcgtgttgtagcctacaaagcatgctggaataaactcgacccaggagggtgccatgaagcagacattctacaagcatttgattatgccatatatgatggtgttgatgtcatctctgcctccgtggctgcgtctaatccctataaggaagctttgttaacagatgggatttccataggagcattccatgcagttgccagaaacatagtcgttgtttgctctgctggaaatgatggaccatcgcctttaagtgtcgcaaatgttgcaccctggtccttcaccgttgctgctagcacaatcgacagagaatttatcagcaaaatttctctcaacaacaatcaatccattacggtaagatatatcatctaattatctagacattaatttatttcatgtcggttaaaatatgtttctttttcatataaatataaaaatacttgaaattcatttttacaaaattttctattttctatatgttttttattcttataaaatttgaaacgtattgatttttatctaaacaaaggttttcataaatctaaactatgactttttacattagtcatatatataattaatataaatgtaatattttttatgtatataattaatgtataatgtgacatatttttttaattatttgtgtacttaatgaatgtaaaaaagtcattcacataaatatggatgtctgaatctttcattataccaaaaaataacacattttaatcttatgagaggagaaaaatttaataaaaatcaatttcaaacatttttatatttgaaaaaaaaaacatattttaacctttttttttttattttcttaacgtctacataattggaccttacgtacatgtatcatatcagggtgccagtctcaatcgaggcttaccatcttcatcgccatcgaaaaagttctatcaagtgattaattctgtcgacgctagacttcnnnnnnnnnnnnnnnnnnnnnnnnnnnnnnnnnnnnnnnnnnnnnnnnnnnnnnnnnnnnntttttttttttttttttttttttttttttttatttcccaagcttgctttcaaatattcgtctcatacgtgtgtgtatatatatgtattggttgatgtagtcgtctttgcaaaccgggaacacttgatcctaccaaagtaaagggaaaaatactaatctgccttcgaggcaataagttaacttcagctagcgaggtccaacagggtcatcttgctggtgctgtgtcagtttttgtgctaaatgatgagggaagtggaaatttacttctggccgaggatcatattttaccagctgcaagtataggtggaaaggaaagtcctaatattgacaacggtacaggcaaccatggcaataacaagtaaaattcatatatcattaaatcccttttaaacgtggtattctatatatatagtatatttgtagcaagtgaagcacttgaatattaatttatatatatgttgttgcagggagattttagcttacttgagtgctgcagaaacacatataggagtaaagccagctccaatcatagctggattctcatccaggggtcccagttccgtgcaaccattgatactaaaggtctataatatatacattttgttaactacaccaacatgacatgatgattaacttttaattcttacaattaatgattcattagagatgaatttgtggctaaccgtaacttgtttcttttttcagcccgacataacagctcctggtgtgagcataattgctgctttttcacaagccgcgggtccaactaatcttgcaacagatagacgtcgggttcttttcaccgtgcaacagggaacttctatgtcttgtcctcatgttgctggcattgcgggtcttctcaaaacatatcatcctaattggactccagcagctatcaaatctgctattatgactactggtgcgttcattaccaaagtaatatcaatataaaatcttcatgcacagcaaatcattggcggcttattaacaccgtactatgctttttattaattccagctacaacactagataatacgaatcaaccgattcagaatgcatttgataagaaagcaactcccttcgaatacggcgctggacacattcagcctaaccttgcaattcaccctggacttgtttatgatttaagcacaaccgattacttgaacttcctatgtgcttctggttacaaccaagctttactcaagttttttggcaatgtgaaatcccattacagttgtcccaagtcttacagaattgaagatttcaactatccttcaattacggtgcatcatcctggctcaaagactattaatgttactcgtacagttacaaatgttgggcctccaagcacgtatgttgtgaatactcactggccgaaggggattaaggttcttgtgcaaccaagttcgttgacttttaagaaaactggagaaaaaaagaagtttcaggttattcttcaggccattggtgtgcctggtcacaacattcctttatttgggaatttgtcttggacagatggcaagcacagagtaactagtcctatcgtagtgctggactcttagaaattaatctcagcattgttatgttatcattgtcattttactttgtttgcttttgttgttttttaggctgtaatataagcgtgctttctgctcatgttgcattcaagtgctttgtccaaaaaaaaaaaaaaaggcacaatcaataatatgcagtttagaaaaaaaaaatccagtgtaaacatttctactgtggaactacactcatctcgaaaaaagttccaatctaacggaccatctttctttcccaccgtgggggccttgagagggtgccccacgcttgccgcggccttcaataatatgcagtttaaaaccccaacaaatcagtgatatcataggtcctagagaggtaattaggactgcgggatgcggtgattaaaggacaatattattgtgcgtgcatgtaatttggcatatttaaaggattggtttgatagtagagaaacgagaggaaagaaaatataaataattaaatatatatctttttaatgtagagagaaaatgaaaagaaaagttatttttaatataaaatttagtttttcatctctcatttttttttctaattcaaattttaaatttttttccctttcatccaattaaatataacataagattattgtttctttttcctttttatgaatttggaagtctatgtatgaaaggaaaaattttctgtaaattacacatacttctcttaaacatttcctttatctgccactgatttccatcacatgaaattgaagcactgtccaaaaatgaccatttccttcttaaaccatttatttgatctggagttcacttaactataaacaaaaaaattagaagaaaaatttcaaaaacaaattaagataggcaatgaaaaacatgaataattttttttccacacacatctgcttcccaatccgctcacaatggcaagtttaatacctatataaaattcttcaaaaatggaaatttgttctgtgaaactacaacaacaaacaaaactaacgtcacagtagtttctcagtgtattagattcttctatatatctcgcactccacagataaaccaataagaatacaaccagatagcaacaacaagccaataacggaactattgaagaacaataaaatttgaaaaacttcaagaacccattgaagaattaaaagaaaccctgtataaaacttcaagaacacggttttgaaggagtgagaaccagaactggattcccggggtgcggcgtgcgaaactctgacggcggcgcagcggtgaccgctcctccttcaatcacgttatcgtcctctgctgcgccaactgaaactcgggacagatctggattctgcatgctgtttaaaagatggggctgaaagtatcgttaaaaaacataaggatgtcgtataataagtccaaactttgggaaagtttttgtaatttatgcttgttttaaacagaaactaaacgttagagagatagcctatgttccttttgagatggccttagggaggtaaacattgaacatcttagaatcaaaatctcaaattgttcctgttttaaaatggccgaatactttctcttctcttgctgaccaaaaaaaaaaaaaactttctcttctcttgttgtttcattctttttggggtgtcctttcttattatatgacaaaactatccttggaagggtgaaatatatgtaaaaagtacttcgatgtttaagttagatttctgacacagaaaataatgaatgtagtaaatgagcaaataaaataatgtgttattttaaaaaatttaatcctttatatacatgtatttatgagcttgcctcttaattgaggggacataatatgaaattatttgataatgttaatatagattatatattattaagataagttaaatttctttatattaatggagtggttgtccagaggatactaaactatcttaaagagattccaaattgtgacggagagaatactaagtcaggccgaaaacgtgcataagccatggcgaaaaagacacgttagagtatcacaattcataagaaaaaaatattatatttactcttaaatgttcatatatatttatttgtaaaaaatttaagatagattaaaaaatatatatttacaattaatgtcaatctaacttaaaatatattaagaattaagatattattttattaaaatttaattaaaatacaccgtcatttatatatatatagatagatattattctatatgatgatttttttataacaattaatttaaaaattatatatagaatgatattttattgattaatatgatataaaaaaattatatttacggggtatgaaaattatgctcttaaaaataaatatatattttgacttaaatatattttctatttatgtaatatacttttaaacattattcattttttaaccataaataatgctaacatcatactattttaaatattttttattaataaaaatttattagaaatcataaaattttgaagcttacgttatatataggaaggaacgtggtagctttgaacgtccaacatattgtacgttaccataatcacccaatagctcaaacatggttttcaccaagccttcattaattcgtttaattctccgttcactcctaagcctcctttcctcccaagttttcacgttttcatcttttggctttgctgccatcactgcttatgaagggacggaagcaagtgctctagttgagtggaaagctagccttgacaaccaaagccaagcttctctgtcttcatggacaagtggtgtcagtccttgcaggtggaaaggaatcgtttgtcacgaatccaacgctgtgaccgctataaatattacaaatcttgggctaaaaggtactcttcacactctcaacttctcttcctttcccaagctgctaactctggatattagtcacaacagttttactggaactattcctcagcaaattgctaacttgtccagactttctcagttgattacgaatgctaataattttagtggctccatccccatttccatgatgaagttggctaacttatcaattctaaacttggaatacaataaactttcgggctctattcctgaggagattggagaattgcagaacttgaagtgtctaatacttcaagggaatcgactttctggtaccattcctccaacaattggaaggttgtccaaccttgttagacttgaattgtccaaaaactctgtctcgggtacaatccccacttcaattacaaacttgacaaatttagaacaacttcagctctcagtcaatagtctttctggctccattccatcctccataggagacttggtcaatttgactgtttttgaaatcgatgctaatagaatttcaggttcaattccttccaatattggaaacttgacaaagctggtcagtatggccattgccattaacatgatttctggatcaattcctacgtccatcggaaacttggtcaatctaaagtttttcgtcctttatgagaacaatatctcgggaattattccttccaccattggaaatatgacaaacctcgacattttcagtgtctttggtaacaaacttgaaggcagattaccaccagcattgaataacattaccaatttgaagtcatttcgtctaacaagcaatagtttcactggccccttgccacaacaaatttgccttggtgggctacttcaaaaatttactgctgaaagtaatcatttcacgggtccagttccaaaaagcctgaaaaattgctccagtcttattagactcagactagatgaaaaccagatgaccggagatatatccgatgcttttggtgtatatccaaagttgaactacgttgatctgagtagcaataattttcatggccacatttcaccaaactgggcaaagtgtcctaatctcacaagccttatgatgcgcaacaacaatttatctggtggtatacccctagaacttggccaggcgcccaagttacagagccttattttgtcttcaaatcatctaacaggaaaaattccaaaagaaattgggaagttgacctctttgctttatctatcaataggcgacaatgaacttttgggtagcattcctacagaaataggtgctttgtccagccttcaaaaattggagcttgcagcaaataatttaggtggcccaattccaaaacaggtgggatctttacttaaattacttaacttgaacttgagcaacaacaaattcaccgaaagcattccttgggaatttaacgaattgcaatctcttcaagatcttgatcttagttggaatttgctaaatggagaaataccagcagcacttgcgagtatgcaaagattggaaaagctaaacctctcgcacaacaatctctctggagccattcctgattttaagaatagcttggcaaatgttgacatatctaacaaccaattggagggttcaattcctaacattccagcctttcttaatgcttcatttgatgcattgaaaaataataaaggcttgtgtggaaatgcctccggtttggtgccttgccacaccctacctcatggtaaaatgaaaagaaatgtcatcatgttggcattactcctttctttcggcgctctatttctgttattattggtggttggaatttcgttatgtatttgctaccgaagagcaacaaaggccaaaaagcaggaggataaagaagaaaaaagtgaggatcattattccctttggagttatgatggaaaaatagtgtatgaagatatcatggaagccacagagaggtttgatgacaaatatctcattggagaagggggaactgcatctgtctataaggcaacattacactcaggacagattcttgctgtgaaaaaacttcatgctgcacccaacgaggaaacacccgattcaaaagctttttcaactgaggttaaagccttggccgaaatcaagcaccgtaacattgtgaagtcacttggatattgtttacatccacgcttctcctttttggtttatgagttcatagagggtggtagcttggataaagtactaaccgatgatacacgtgcaacaatgtttgattgggaaaggagggtgaaggttgttaaaggtgtggcaagtgctttgtaccatatgcatcatggttgctttcctcctattgttcaccgtgacatatcaagcaagaatgttcttctagatttggattatgaagcgcgcatctctgacttcggaacagctaaaattctgaatcctgattcacaaaatataacagtgtttgcaggcacatatggatattctgcaccaggttaggccatttttgttcttaagaatttaatcctatatatatacttgtttcaattcaataataagtcctgctacttgttttataatactatttttattattttgataaattacagagcttgcttatactatggaagtgaatgagaaatgtgatgtcttcagtttcggagtgctttgtttggaaataataatgggaaagcatccaggagatctcatttctgcattgttttcatcatctgcttctaatttgctattaattcatgtgttggaccagcgactacctcagccagtgaagccaattgttgaagaagtgatcttgattgcaaaattaacatttgcttgcctaagtgagaatccacgctttcgcccaagtatggaacaagtgcataacgagtttgtgatgccaaaaccatcttctttggatccactccccatgatcacacttggtcaactatctaaatagtgttgaaacttgttttctggtgtgttgtatgttttttagttcttttggtgttcactgtaattaagcttttcgtgatattaatgtttttctcttgcatgttttgtatgtttctgaattctgatggagtgctttgtatgtttcttctgttctataaagacttggaaaataatggaaagtcgcttatgtcttttgtaagatcgaataaataaagtgtgattttgaagggagacagtcatgtttttggtctttataaaataaataaagtcactttatataaaaataaatataaaagctactttatcaaaagaaaaaagtaatgtttttcgtaagataaggatattttgactgtatatttctttgagaattatttggcgttaacggttagccactcgatgaagtatattgcatttaattgaagacactcccaagtcccattatatattaggactttagtaatctacaagaaaactcgtataaggatattttgaagaataaatttgaatacaaatgttatatattttgcacaaaactattatacggatatttttttttaaatagaaaaaattaatattatttatgactgatatatgcaacaatgtttaatcaattaaacattttattaaatcacatgtcaattgattaaaatatttatttttataaataatgttgtattatgaattttaataaataaatgttatatgaaatttgcataaaatgagaaattaattaaattaaattaagtagtttgattgcttcaaaattaaaagttttattcattattataaaatataagaaattaatatatttaagagactacaaacatatttctgattaatatatttgtaaaaataagaaaacaataaaaatattttagtaaaattgatttctaataaatactatgatattggagtgattatttttcttagtgtatgtgaaaaaaaaataatactatccctaccctagtatagatgccatctcacggttgttacaaaaggaagtcgttcctcacaaaaaaaaaaaaagaaaagaaaggaagtcattggtttgggtccaccaaaagaaagaagaagtcgtctttggataaatctatctaaaagttttttgtgtcttgttcaacggatccatctaaggaaaatataattccatttgtaaatttctttagcttaaacatgcctaatgtacatttctacactattagaatagctaatatgagttttgatttaactaaatcttaccaaatcaatttataagattatttttcatttatatattttatattttgtacaactctaatcaatgtgatattttttctcaacaataacaaatacattaattgcacaaaaaattgatatttagatttatacatcttcctaaaaaaaatttagatttgatgtgtagataacctgatttgtgaccttaaaagagatttccatattatctttaaatatgggtttaagtttaacttaatcatataatgatgacttgtaaagtgaaaattcttctccccttatatatttattttaatattatttctattcaatatatggcttaattatgttcaatactatatgaggcttcattcttgtttattttatatctaatttcattttatttatttatttttaaagcaaagtggtttgatcagggatattttttctaaagcaattgtctttattttttaaagataaataattccccaaaaaaaatttaaaataggctaaatcagatgcaatattttttttttgaaaaaattggaaaaaatcccaagaacactaaaatccgcaacaaaacacagtattacaactttcagccaaaagggcattatacaaaaaatcaaagaccttaattgcctaatcaaatgcattatttcaacacaggcgtctttgctttaagttcacgtccttatctccttttttatttttccacttaaataaatagtattaatttagtatttctattttacctatctcttttctcttttaacccacactatttttcttcaaaccactaaagaaatgggaatttctgaagtaaaaaatcggtcactaacataaaaaatccgtcgcaaacaaataagataatgatgttgaagtataagctgaattttggaccttatttatctaaaccagaagcaatttgcgattacaactgaaagaggagtcggacctagacgtccctgttccaaaataaacaagatgatattattgcctgagagctagaaataatgggaagatgaagatcactacaacaaaaaagcttatttcccatgacatatttccgaaggaaaagcattctgtcggtaacggatgaaataaaggttattgtaactgatttttattatattaattaattaatttattgtggaaacctaataggtaaagcacactcaccagcattgcagcccaaacacgaaacctaagcgcctatcactccctttctccaccaccacagccgccttcccacccttcccttagcccatcaccgcccgccgcactgcttgaagacgattccaagcgtcgcctctcctcgacccggaacccgaccctgaacccccttctacttcttctttgccagcgtcattggtgggcacgtgtggagtgccagagtcacaggctcaccgtggaggatcccgtcacggttgagtacataacgcggtacattgcggggctgtagcagaagtacacgcagagcggcggcgtgcggccctttgggctttcaactctgattgtcaggtttgatccctacactggctcgctgtctctctaccagacggagttaatataatccaccaagtgttgcgttatctttatgttaaccccccctcccccggcgatcttactgttatggttttaaatctgaatatttcaggtccttcataatattgcaattgcggaattctgccgagatggttcttcagatcccaagaagttgcttgaagtaattaatggcatcaaggtatgctattttaaatttcatcttgttttggatttctgcaaagtgacagttttgtgatggccagtgggttttatttttcatggatggtatttgaaggaagccattttcacttgtattacctttatggattaagaaactggaactgcatgccattggcaccaattaagaataagatgacaaaattaaaatgaagttagacctaggtcataatgtggcctttttaaaattgaatttctgagcctttacagtggttcatgcaagtattttggggtcaatgaaatgctatgttggcatgtgatttgagccagtggaatgagtgtttaagatatacagatgaatttgactcttctgtggcaatgctaaatattgtatgttcattttgctccttatattaatttcatttatatctctcttgttgctttgaatttatgtgatttaattatatttgttgatatagcttttgttatttcaatctctttagggaatcatttggttccatcttcatgactatgcaaagacattgtcagttttggaacctctctttcaaaatattgaacccatagatgatgtatgtcatatattatttgatgtttttttttttttaaattacattgaaatgctgatggctttgttttgctcctttattttgtgttctcttttctaaagcagacaacagctctacatatttgccttctgctgcttgatgctagccttgcttgccatgatgcatcaaaatcagctgtaagttatatttcataatgtgattagttggtttacttcatacttattaatctcggatagcggcgcgtagcggccacccctaaaaaatgctatagcgctatagcgggtagcgctacaccgctacagtaaagtatataagtgaatattattctgaaatctgaattatatatataaattataaacttcaaacataaaggactaaaacaaactcagtaactcaaatacttaatttcaaacatgaaaaatgaaaaattagaagtcagaaatagcaaaatgaaggtacggcttaggagatatgaatgctttaaaagaggagagtagagtttcttagagtttctatctttctgaaagagtggaaaaaagagtgaaagtatggctcgttcatgctgagagagtttattaagtattataaaggagagcttttatattagatttatttattagtattagtaattacgggaggagaagagttttgttttgatttttaaattttaaaatagctgcaccaaaaaactataattactacttactagcctatatttaggttttgatttttaaattttaaaatagctacaccaatgaaaaaactgtaattactacttaccagcctatatttaggttttgatttttaaattttaataactgcaccaataataaaaaaaactctaattatcttaccagccaatatttacgttttgatttttaaattttaatagcttttgatttttaaattttaatagcagcagtgctgcaccaataaaaataaagggcaaggcacgacggttaagatttcattaggcttgcccaatagtaaaacagcaagcacgatatttacgctttttgaccaatagcaaaacagcaatgaaatgctatttcgggagattagatgcggcattagcggtctatttttgataaaataggaaaaaatctttcttcccaagctagatgaattgcatatactaattagcggtctattaggtaattggctatacatgataacgggaaaaattctattagcggtctattaggaataaattacaatatttaccattgttgatttgctttggataattccattttttcattgctttatggattaattggcttaaacctttcaaatggagttctgcctcaatcccccatgcactccaagagcctggctgttctcaagaaacaggtggataaatgagtattggtatttgttagtaagtaactatcatgattgaattagatatttgatatgctgatttttcaatggcagttgatccgaagaaagatggttataagtggcaaggaaagcataaggcagaaagctagcaagtctgaaatatatgggaagatgcaagcagtgtttatagaaatggatagctgtccagatgtaagtataagtctttaatcctcttggccctgccaccaattaatctaattgacacatagttaagtttcttttttgtgtactctaagtggatgtcttcattcttatggatgtcttgaagggggtttctgtttttttggaaatgttcacagagtggctttctgtataaatactttaacctgaattttgcaatgtttaattaataggccttctaactatcaggttttgtttggtgttaccgtgatccgtttctcataatgtggcttattttttatttttaattatttaaattaagttgctctttgttgaattgatgaatggaaattacaatatcagattctctgtcaccgtgaatgtgttgctaaattcaggttaaagtatttatcttttttatttataaaaggattgcatgactcatttcagcttgtcacttgtatgtttttgttgttgcaatgcggcttatattcattttagctttgtttctataatctagctgaaggcatgcttgttttttgcaaatgtttgctttgatcaattgcaaacctgaaggtctgacccttgtctcattcggtcaacttaactgatttttgcattatgatgttattgcaaattctcaacaaaatgaccaagaacatgccttgaacaactacaaaattgttaggcatcttttttttatcagtaaattgttaggtatccgaagcagcaaaagaagtgaaagaactccaagaaacaactctaaggacttaactgcaggaataggattacatcaagcgcccttaagtccttacttgtttactcttgtcatagatgtgtgtgcttactagtgacatacaaaagagtatccgtaattgcttgttttctgtggatgatatatttgtgattaaagaatgtagagaagcagttaattttaaacttgagctttggagacaaactctagattatcactagttgcatgctttctgtgtggacacaaccataagaagaggagaaatcattgttattactttatttattaacttctctttcattttactcaccctgtagaggaaacgaaacggtggacgtagcagtacttcaagaacaaacggtaagccttgttaattatttcacacatgtgtaggcctcataaaggtttgtatgccatgccagtgattactgccaagagttctctgcctcttaattccttcctttcacgtggatgtggtagttttattgaaatagcccatattatttctaagttcaaatagcccatagtattaaaattaagatggatgtgacttttaaacttgattaattagttgttatcttgaattataagctaagttaaaactaagatggctgtgacttttaaacttcactttgcattagaaattgtacgtgacttatttgttgtaatagtatactacttcaattccctgccaaaacctttttaaatatttttctgtttttagacatattctaagggccacatttagcttcatatattgttggccctgagattgttcagaccttagtgtttgtcatatatggtgttacctattcttttgactcagggatgtatgtgattctatattgatctttatctctatttctccatttactttttattattactaattcttgttacatgaatggaaagtttgaccttgttgttgttacaccctacttggataacacaatgcctgctgcaattagaatgcctgctgctatttcaagactggttgatatagagttatttatttttcaattttttctttgaactcatagtagttagggggcatagtacatactgcctatatcatatccttcaatcttgtatctatctgcatgtgtatgttatattttgaagttctatattgcatcagtttgttgaacatagatttctatatatgcaggcagttgttgatgagtgggcatcaagtcttttccgggtatgttctagagtatgtgtgtttgcatgttaaaataatatgaaattattttcactaagtcttatacgagatattagttgaatttacttttcagtttaattttgttatgttacaattatttactatgctgacttggcaatgagtcagactgacagctattatagctggttctcttgtatcctatacttaatgaacgatctgataattttctcttcactctgattctctctctctctctctctctctctatttcctgaattctatatgttgcatggtctgaaagcatgtgagtatggtctggttcttgtcataattatagaagttagaacatatttagcacaagtttggtgtcaaaagtacttttcaacatgattattcacaattagagaagagcttacaactgcaattttacttaaagtgaatctttattttttcttcttctaaaaacagtttgtgcttacaactgattttagatgtgagattcacgaattatattttttttagtttatgattgtttataagttagaaaaatcactttttgcacttttttctcaaaagcacgtacatttccatacaaatatatgattcaaatgaagaaaatacccataacaatctttgatattctctttccaataaaataatataaaattgaaaaaaataagtctaattttttaaagagttttaacggttttctatcaacatttttattattattgtgaccgatgctgttctaattttgactgtctttttatctattgaatttgaattgtctggactaatttaattaatagtatgcttttttgttgaattgattaaatataattattatattcaatgcactagattctctttagaaattaaatggaatttaattttcctttttactccctttgttcttatttgttcttatttataagaaggagaaaaaactaattttacattaattaattaaataagttagttatctttattaaattgtgtcaatttcaaattaaaaacaaacttttttctaaaattatcattcattataacttgatatcaagtattaacctcttattaaattaacagtattttaaagatagtctcatcaaatgagaaaagtaattaaaatttaattaaaaatatttatgtgttgtgtacaaatattcagcaatgcatgataatagtattttagatctgttgattgagtgaattaaatgatttataaatcttaggctaggagcatgtgttggacaagattgagaatttgattggctggagtggtgtgtgttagagaagggcattagaaagataaatttctctttttattgggctgtgtggaacagagttgagtgagtgtactggatgtggaaatcccttgacaaatattaatgatatagcttgtccagtttaaaattacatttagaagttgaaataaatgtggcatggaaggtggaaaaagtccagactcgtatgcatctaatgaaataaaattacatttagaagtttaaataaatggagtggatcaatccctatggttcattctgtattcaatcccttcccctgcatatattggattgctttgtttgtaagaatgtttatattgtatttctttgtaattacttttgttgattttgattagttgtgtaaccttgtttatttatattggattgctttgttgattttgtaaattaaaaatatagttaatacacattgaatgtgtgtaagcattgaatgaaaaaaatataatttgattttttttttaaaacacattctaagacggttctgaaaaaaaccgtcttagaatcctcaatttttttcttttaaaaattacattctaagacggttattttaaaaaccgtcttagaaggtgtcgatgtagaaagcacttgtacgtgtatttccgacggatttatctgtcggaaatttcccacgggtgattaccgacggatatttccgtcggaaattaccgacggacgaaaaaaaattccgacggccaacatttcctacgagcgttttaccgacggatttttgtccgtcggaaattccgttttccgacggattttcgagtttaacgacggatttatccgtcggaaatagcgatttttttttgtagtggattgaaggggatgatatggatgcgatgtttcactaagctaggatagactttggtgagtttcacttctggatttgcattattttatgggaattgtgacagacacctttttttgtttttttaatagacgcattcactaatcattatagagctttgtttgacaaagttttatgtttggagagcctcctccctctcaatttaatactttaacgtttgctatgaatttatccgctaatataaagaacctcttgttacaaataacgtacatactatttcgaatattcttcaagatacatagtgaagtcacgcgggaaggattcaagtcttataaaatatatataaaaacgtgtaaattgaggacgagtgactatcgatgtaccctttactttcactttttattttataatttaaatttttattcactttaaaaaaggcaaaaaataaaataaaataaaggaatgcccaagttaatacgattcacacgatgatgttcttatttctactaaactagtaaagtgaaccgtctgacaagtttgaattttgaaaataaatatatctatattatatataaagttgataatgcagatcttagtaaagagtaaaatgattcactattctttgacagagtaaaatgattcagtaatgttcaacataatcattatattttaaaacaataataataaaacttactatatacattaattaataatttcaacttaattataaatttaaatgtaatttatgagaaattctaaataataaaatgatttaatttctaatatgtttttatagttacaacaattctttttagtctctataatttaaaatatctcattttttgtctttacagttacaaacttttatcattttaatcaatgtccactaacgccatttgaaatgaacatcattaagttataattttagacgacaatgatcaaaaacatgaaaaatgataattataggacccaaatttaaattacaagggttaataaaaggaaatattgttgcaaggactaaatgggaaattaaacataataaaattatattacaggaaataaatgttatagaaatgtaggtaaattataaataaataaatttagaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnacccttgtaaaattctttttcttttttctttttgtccttttaattttgttatagttcttgtaatatctagattatttgtttttagtctctatcaaataaatttcgaagagactaattcaaaatgcaaaaaaaaatattatagagactagaaaaatatgtattacaagaactaaagcaaaataacaaagaacaaaaccaataaaaagaaattctatagaaatctttctgaaaaaacatttttttaaagactaaaaccataaaagcaatatattccggaactgaagagatatgtaagccataaatttatatttaacttcattgacgaatatgtctattcaatttagcttagcaatcaaaccatatattaatgcttacatgataggggacaatgtcaccaaatgtttgtcgatatggacaaatatggatatccatatttctagacaaacagattacaataaaacctattaaaacacgtatgagtttagaaaaatgatattttaaattataaacattatattaatatataaatattattaaaatacatatttgaatattaattaataatattagtaacaaaagaataaaattgtgaacgagtaaagtaagattttgatttaacagaactttacaaggttaatgggttagaattcagatgtgactttttaaactagttattataaaaattaataattttattatatgagataataataaataaatattttatagcatagaatgtatatttcaattttcgaataaaattatgacgggtgaagggcaggtaaattcgaactttttttatatcaaattatgtggtttaataaacttatatattaaattaagtgattttaaaaactatttatcaaagataagtgattttaaaaagtatttatcaaaagataagtgattttgacttttaacattaattataattatatttaatgtagaaattacagtgacatttgcatcaacagtggctataattaatgtagaaaaataattttttaaaattgattgtgattataatagatattaaaagtcaaaatcatttatcatataattttcaaaatcatttaatttggtaaaaaaaaaaagggtaaattctcggctccattaccatcaacggtgtaagagtatgcttctagtttcaagatccttctttgtgtttttggcttccttgtaattttgacttctcaatggtagtagtagtggtggggaaggaggggatggtacagtgtcccgtaaagccactaagaaaaagagagaaagtacgtttaacaaaagaaaataaatttgagataaaataaaagcttaaagaaatgtttttttcttatgagaaacttatgaattttgcagctagtccttaataatttttttttttactattgtcattgaaaaatagacaaattttatatttggtcccttgaattttttttattttgtatttttttcctaccatttcattggttttgttaagtgctccttgaaatatattttttatttgtcttttggcccctaaaatgttttccatcaattggtgacatctcaaattaacaaaatcaatataacaacagagattaaatataaaataaaatattttttaaggatcaaaagtttttgtttttattaaggatgaaatacaaaattgatggatttttcaataataaaaaactatttgagcattaaataatatttggcatattacatagtttagtttggatgtaccagatttgtattaccaccgcatcagatcatttggagtagcgttattgtgtactgtgtatagttatttcgtggaacaaacataaatgcactctaagagtacttcttggaaaagaannnnnnnnatatatatatatatatatatatatatatatatatatatatatatatcaaagaaatttagctcaattaacacatggtgtatgaattgttgtaaatttcttgatactatctttaatttctacaaataaaaaaaatgactatctatgatatataatttacacaaaattatagcatacatggattaaatttatttcaaatagaaaaaaaatgaaaacatttgtgactcatatttgaaagaaaatttaatcaattaaataattaattaaatcaaattaattttaattgattaaaatattttttcttcaaataatggtctactatgaattttcataaatacaattaaacgaaatttaacaaatgaaaaaatcagtcaaattaaatcaagtaaaaagatactgtaattaaacttcgtatagggtaaataaagtattactatattttttgttattatttgatgttaaaaatcattaataagttttttaaaaaattaagatgaaaagctgtattaatctaaagtttattacgtgacacaatcgttgataatatttttttaagaaaataataaatagataaggaaattatatgttcgctataaaaaaagagtgatagggtttacttggttgactattgactgtataaactaaagtagtctaaaatctactttcaaaataattcctgaaaagctaactgtttggtttttttaaaagtagtctttgtaaaacaattaattgaactgaacatgttaataaacataaacaacacattcagatcaaatagtggaagcagaaatagaaagataaatttcagaggtacctacctccagccattgctaataaccttcaagtaatcttcagagttttagttttccagtccttcactcgctcaaactcgatggtgtgttttctaaaaagaggagtaggcttggtgatctaaaacagagagtgcccagtgctatttatagagttctgcccatcacagaactcaatcaagatgagataagataatgggttagtgggtgaacgtggccaataaatggaccacatacagaaacggtttccctaaaaagatatagactgaatatctaaatattcttatcttaatggaataaaagatataaattaaatatctaaatattcatatcttttatttattcctatctttatgaaatatctttttagaaatataaaaccaacattctcccacttggtccatttaacccaacattagttataaaagaaacaaaatatacgagtcatggcgataggtcttctaattaatagcgaatattatcttccatgtaccacaatatataaagtctctaaatgctagctctcaacttaatgaataaatcatatatttattctagatcaaaacttaatgacatttctcaaaaataaataaacgaatatgtgcacaaaactttatgagaaaatatcaaactgaataagagtttcaaaattaacaattgatttttaataaaatcatatcatggaaccaagtcccattcgtactacatgatccttaaaattctttggtggcatgcctttagtcaaaggatcggcaatcatcaactcagtgctaatgtgttcaatgaccactttcttttctttaacacgttcccttatggctaagtacttaatgtcgatgtgtttatttcgacttccacttttgttattcttagccatgaaaactgcagcagagttgtcacagtacatttttaatggcctagaaatagagtccataactctaagtccagacacgaaactcttcaaccatacaccatgcgaggtagcctcaaaacatgaaacaaactcagcctccatagtagaagtggcagtcaaggtctgcttggcactttcccaagatacagctccaccagctagcataaagatataaccagatgttgattttcgtgaatcaacgcagccagtatagtctgaatctgagtagccaatcacttctagacaatctgtctgtctatacatgagcatgtaatcttttgttccttgaagatatctcatcactttctttgcagctttccagtggtcaatgtctggattgctttgatatcttcccaaaactccaacaacatatgcaatgtcaggtctggtacaaacctgagcgtacataagacttccaacaattgaagcatatggaatattcttcatgtgttcccgctcaaaatcatttttcgggcactgactcaaattgagtttgtcacccttcataatgggagctacacttggtgaacaatctttcatgttaaacctctctaaaactttgttaatataggtctcttgagacaaacccaaaatgcctcgagatctttccctatggatcttaatgccaatgacataagatgcttctcccatattcttcatatcaaagttctttgagagaaattgtttcacctcatatagtaaatccttatcattagttgcaagtaagatgtcatccacgtataacacaagaaaacaagtcttactcccactgaccttttggtatatacattgatccatgatgttctcttcaaaaccgaatgaagtgatgacctcatgaaatttcagataccattggcgggacgcctgttttaatccatagatggatttattaagtttgcaaactaagtgctctttatcactagaggagaatccttcaggttgtttcatgtaaacctcttcctctaaatgaccattaaggaatgctgttttcacatccatttgatgtaactcaaaatcaaaatgagctactaatgccatgattactcggaaagaatctttcttagatacaggagaaaaagtctccttgtagtcaattccttctctttgagtgaaacctttggcaacaagtcttgccttatgtctctcaacgttgccttgtgagtctttctttgttttaaaaacccatctgcatccaatggcttttacaccattaggcaactcgacaagatcccagacttgattagatgtcatggaatccatctcatctttcatagcattgtaccataagtttgattccttagaactcatggcctgtgaaaatgattcaggatcatttgcggctccaatgctgtaatctgattcttgcagatacaccacataatcactaggaatttctgaccttttgactctagtagaccttcttaatattgcttcattatcttcttgaggaacttgttgttcctcattagcaacttgatctatagggtcattttcaacagtttgtggattttcaattactggttgtctaacacctatttgagcttgaggggtgtgcctgacaatcaatctttcacctgagccagagggttgggctttatagtgatccttttcaggagtaatatcctgaaattgactactcctactgatcaagtcattctcaagaaattttgcatttcttgattccacaatcctagtgctatgtgatggacaatagaatctataccctttagacctttcggcatatccaatgaaatacccactaatagtccttgggtctagtttcttttcttgtggattataaattcttacttcagacgggcatccccaaacacgcatatgtcgcaaactcggtttccaacctttgaataactcaaaaggcgtcttggagacagccttggttggaactcggtttaatatatacactgccgtctttaatgcttcaatccacaatgacttaggatgcttggaactactaagcatacttcgcaccatgtctattaatgttcggtttcttctttctgctacaccattctgatccggagaaccagacatagtgtattgggcaacaatcccatgttcttgaagaaacttcgcaaatagaccaggtgcttgtccattttccgtgtatctaccatagtattcaccacctctatcggatctcacaattttaatttgctttccacattgtttctctacttcggccttgaaaactttaaaggcatctaaagcttcatttttagaatgaagcaagtagagatacatatatcgtgaaaaatcgtcaatgaaagtgataaaatatttcggattacttgcttccatatctggacaacaaatatctgtatgtatgatttctaatagatttgagctcctctttgcacctttcttagacttgttagtttgcttacccttaatgcaatctatacaagtatcaaaatcagcaaaatccaaagtactaagtaccccttcatttactaatctcttaattctctcgatagagatgtgtcataatctacggtgccacaacatagaggattcctcattcataacacatcgttttaacccgacagaaacatgcatagaattataagcagcattattttccaattcaataaagtaaagtccatcaagtaatgaaccagaaccaataattccagatttattcattaaagtaaaaccagaattcgaaaaattaaaggaaaaacccaatggtgcaagtcttgatacagaaattaagttcttagaaaaacttggaacataaaatatcttgtctaaatgaaaaataaatccgctgcttaaaactaaattacatgtcccaatggcttccacatgtgagctcatcttgtcttctgaatagatgtactgctcacttcccactggcttccttaggttttccataccctgcaaggtattggaaacatggattgtagaaccaaaatcaatccaccatgtgttatgattaacattaaccatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacattaaccatattagattcataacaaacaaaagttaatggagtacctttcttgtcaaaccagttcttaaactttgagcagtctttcttcatgtgtcccttcttcttacagaagaaacactttgactctttcttaatgactggctgagcaggaatcttgcccttattcttggcttgatcccctttcttctttccctgagtagtcatgtataccttttcaccctcttccattatcaacctttcttcttcttgaacacacatagtcaatagttcattaattgaccatttatccttatgtgtgttataggagattttgaaaggggcatactgaataggtaaagtacataaaatgtagtgtactaggaaagaatctgacatggtaacttccaaatttcttagttgagccactatatccctcatgcgcatgatgtgatcacgcactccttttattccatttagctttaaggatgaaaattgcattataagggtgctggcaagggccttatcagatgtaacaaattgatcatcaatggccttcaaaagatccttgaccttttcatgctgatcaacagaactacggatactagcagatatataagtctttatgaacattacagagagacgattagatttctcccatttttcataaagattaatagcatcttgagtgctagtttcattaatactcggtggttcagttttcctaatagcatagtcaatatccatccagcctaaatgaaaaagaattctctccctccaaaccttataattgtcccctcttaattcgggaatttcacacttaatatcagaaatatttccagattgattaactgaaattcaaacatactttttttcagtattcataatttgagactaaataaatataatgtttttaccaatgttaaacatgtattatgaacctagtgacataaaacttgcctgtgggctaaagtcctactcaaattagattcaaacttatgataaaactatcaaattataataattatttttcttaattcctgtgggtaaattaagaaatataacctgatattttatcctaattaatcatacaaatataataaaattcctgtgggtagattttattacattacgtatgattaatcacaattaatgttttaaatgtgattttaacacttaatatataagtttaatcaatcaaagatgctgtggctattctctaatcaattaaattatattaatcacttaacattaattcttaataagagctaaacaattgcataacatccttaataatgcaaataaattgagataacattagatatagttattcaataagctcattaatcaatgtgaataaattatttaacataatattgtatatttaaacaaataccataaataaacatacaatttaaataatttaaatacattactcataacccaaacaatttattacataaataaatcgattatgagcaatatttaaattaataattaattatattattaattcaaatacattaaaacattttgtatatagaatgtaaatatcaacgtgcacgtaagctttcaaaaggaagcaatttgtaattaggctttattttaaacataaaggctattaagcttcttaagtataaataaaaggcacttcaaaaaatttgaacagcaacgtgctagctataagccttttagaaattaaccaccacaaacatggcccaccataaagataagaaaaataaaccacggaaaggaaacagaaactccgaaggaaaactagacgcggggcaagcatcaatgaagcgaaaaatcatcgtcttcaaccaccgtaaacccgcataaaaaatccaatagtttattttaaatactgaaatttatattttaattcacataaagcttagaaatttaatttctatataatttcaaagcttcttaataattaaaacgttcaaataaaatactcatatttcaataaaacaatatttaaaaaatatgagtgtcaaacaaaagcaaagcagaggcaaaaacaggctctgataccaaatgtaaaacaattaattgaactgaacatgttaataaacataaacaacacattcagatcaaacagcggaagcagaaatagaaagataaatttcagaggtacctacctccagccattgctaataaccttcaagtaatcttcggagttttagttttccagtccttcactcgctcaactcgatggtgtgttttctaaagagaggagtaggcttggtgatctaaaacagagagtgcccagtgctatttatagagttctgcccatcacagaactcaatcaagatgagataagataatgggttagtgggtgaacgtgaccaataaatggaccacatacagaaacggtttccctaaaaagatatagactgaatatctaaatattcttatcttaatggaataaaagatataaattgaatatctaaatattcatatcttttatttattcctatctttatgaaatatctttttagaaatataaaaccaacagacttcttcattttattttattttaaataattcctgaaaaacttaaagttaaataggctaaatcaaatgcattacttcaacgcatgcttgcttccttgattccaatcagttagatcactcttgcaactccaatatgaatgtaattaagtagttgaagtgctgttggattaattgaaaatcatctagccccttcttattttcaaccgttggaatgtagtgtgattattatctcaaactcacccaaattgaaccaaattgcaattgattggtttgatggtaaagatttgacctataaaataacaccatttaacaataatatgcatactgcttgaggagacacaaatgaatctaaagtcacatgactatctaaactgatggactgggttaaagtattaggcactttcattgtaaataactggcatgtgcttagtcatgctgccttgtatgcactggttgtatgcaaccaaggttttaaattacggtcaggtcccgttagagtttcattgcagtatttgatgttgtggaaaatttcagataaatgtaactgatgtggctgcgttgattttatactgcagcagaaattgtcattggataccactttttaaaaccttgaataccattttatagtaagagtttgaaaatttttccttttggagagcctcctcttattcgctaatataaaagcctattcttatccagaatgtaaacattcttgagttaaaacttcaagataatagtggaagactaattaaggtcttcaagatatacatagtggaagactaagattgatcatgcattcagcttttataagtagactaagtgtaaagtgagaaaggaaagagtattgattgcacccttttcttactctcactctttttttatatcacttttaaatttttattcacttttaaaaagacaaataataataataaaaaaaaaaggaatgcccaagttaatgtatttcagacgatgatgttcttatttctagcgtggtgaccaggccgacaagtttggttttgaaaaataattatatctatattatatataaaattcacgatgcatgtatttttaaatattaaaatgattctctaatgttcaatataatcattatactttaaaatattaatacaacttaatatatattatatagtaattgcagcataaatgtaagtaatgagaaattctaaataataaaattatattacaggaaacaaatgttacaataatataagctaaataatataataaatttatatttaacttcattgagtaatgtctatttaattggtgtttacacgatgtatttacaaattaaaatattagattaataatctatattaatatataaatatattaaaaatatatattaaaattttcatagtactaatcttacttcatgtataattgttggaacctaaatttgaacttttagtagcccaaaccaaaaggtcaaatttgaataggcaaatatgactgaagtaagttcagcagctcttaattctaagagaaaaaaaaaaagttcagcagcaaaatggagcaaaataaatcacataaagcccaaacaagatgtttctggtatcaatgggcagaatattaaaaaaatattttgataagaaagctgatgataaggttgttacggtttatcataaggaggccaagtcaaaaaggttggttaatcagattaactgcatcattgtatatagcatacatttagaaaagaaaataaacttagctctacataaacttgcatcattgtatgccgcacaaaggaaatgtctaaagatcatgaaatttgataaattctgaaactcggtaggtttttcagaagaaaggttgagagccaacatttacaatttagatatgtaggaattctactttatttactatcagccaacatttttaccacttgtaataaacataaaaattacaacttttcaatattccagtaatcttaatctacaaaaaaaaggaaattaaaaacattttcccaaattaaaaaacaattactgacttgaaagacttattcaacaaacgaaaataatagagagactatgttctgcttctgcaatcctaaagtaaatattaaacagatttgctgcaaaataagaaacaaaggcccagcaaaatacatcacaaagatccgctggatgcatggatcactgttatatacaatggataacaatttgccgacaaaaagtcaataacaatagataattaaatcactcgcactgaaagcaataccagtagtacactagcacttcctataattttgaaaaataatacaaggtgacaacatgaaagtagcgacaaaaaaacctaaattaggggtttaattatcatagaatttgatcttaaccccacaaaactgtaaggtgaggaatgccaaagctttgtaagacctcaattgggtgacccaaatgcccaataacagatttatgatatgctctatagctattttaaaatttaggtttaagacctatcaggatctcacaaaattaaactgtaagctagagactgtctaagccttataagaagtaaactagtcatatgtttattcgacctggaatttgttgcagcccaaacatacacaatgcccaagagggacaccaaaacacccatgcacttcaaggactaccagatgagctgatcaattagaattaggattatcttttagttagtttatcttatcttgccatttagacttatcgtaattagaattcagctttgttagtttagattacgataaaagtttatctttaatgcatttgaattctgttaggattagaatttatctttgctgcatttgaattctgttaggattagaatttatctttgctgcatttgaatttgaattctgttaatatctatttattgaagttgaataatcagaaaaggcatagaacttttgtagaaaatctctcttctcctttctgtgatttcctcccatctcaactcttcattcttttctaaattctggttacgtgacagtgctacagaatttcaagaaattaggattaagaacattgtacaattcattaatgtgaatatttttaatcagaaagaaaaagtttcattgatcagttttacgaccgtttgttattacttgttagaattatctttgcacataagctccatacatgattgtgagggtgcctaatacaaacacagctccaatgaaacgatgttcgatacaacattccaataataaaaagcacttaagactttctacctaataacatcaaacacaaacgacaatgataacatttctgagagtaatttctaaggttacaggattacaataggactggttactgtgtgattgccatctgtccaagacaagttcccaaatactggaaaaccacgactaggccaactggttgcctcaagaataacacgaaagctcttcttttctccaattgtcttgaaagccaatgaacttggttgaacaagaaccttaaatccttcaattacgttagctttggcaacatatgtgctatttggagtccccacattggtaactgtacgagtaacacttatagggttcatccctcgatttgctactgcgatcgaaggatagttgagattttcgatgttgtaagactttggacaattgtaagagcttctatgaaagtatttgagaaaatattggttgtgatcatgggcacacatgaagttcaagtaatcccttgttctcatatcataaacaagtccagggtccatagcaaggttaggctgaatatgtccagagccataatcaaatggagttgctatctgatcaaaggcgtcccgaattggtaggttgttgttatcttgtgtggtagctacaggaatagcataatttctatcagaattttttttccagaatttaaagtgcaattttttttttcaacatttataacagattttttattttgcatttttagttcctcagatgtcataagtgtgtgatttgaattttatctcatttatcatgaggttcctctatcctcattctatctaatatttaacaaaattagctaatgtgacatactgacatgacatcttaaaactctatttacttactgatatcatgtctgtttgtcacatctgctaattccgttaagcgaaatgctagcaattatcaattgatgccattgaaatttaaactacaaaaactgaaagactaaaaatacaataaagccttaattatatttttgactaaggtaaaagggtaatcaatgtttcttttggtatatgcatatagatgtattatttttgccaacataccagtagtcataatggctgatttaatagctgccggactccaatcaggatgaagtgttttgagaagacctacgacaccagcaacatgagggcaggacatagaagttccctgttgtatattgaaaggaacacgacgtctatctgatggttgatttgatggacttgcggctagtgaataagccgccaatatgttgacaccgggggcaattatgtcaggctgaaacagaaaacagagtattgaatgtgagaaaatggaaaagaaaaatatatcatgatgatgaaatgaaatgtagaccttgagtatcaatggttgcactgcattgggacccctggatgagaatccagccacaattggagcaggctttattcctaaatatgttcttgctacagtcatgtaagcaacaagtttcctgcagagaaatttatagatgaagtttttcatttgctgcgagtgtttttagaatgtaagtaacactgaaatgaaatggattagtgtctgtttgaattcatgtcagatcatccaaaatgaccttgaaataccaacttccctgattttaaataaatatgtacatgcttggtctcccgttggaaaattgattctgaatcccaagttaaaccattaaagtgatatatgattacctgctactgttatcgtccgaacctcctttttcaaaccattcccgttcatcaatatccttatcctgactgacatccacatttgcacctggtatagtataaggctcagctagaagtgaaccgccactttgcttgccattaaccacaaacactcccactgcgccagcattagcagcttcgtaaccctgagctactgatgatgttttatcacgtcgaatgcagatcaatatgtttccctttatttttctaggatcaagtgctcctggcttgcaaagaccactacggcagtaacacactcataagaaacaagaagtaataaaaatataaccaataacgtaaatatctgaagcaagttaggggaatttgagcctacgcatcttgaattgtggcattaggaagtctagcattgacagcatgaaccaatggataaaatttccgtgatggtaagcctctattaagactggctccctgatacatatacatgcaacccaattaaattaaattgatagacaatatggttttctctatatactaatcatatagcaaaaaataaatgccatttattctattattcaatcacaaattgtcttatacgataagtttattcacttttatgttaactatcttacaagttatattaaaaatgatttttctaattggtcgatggtgtggaagtttttgcataaacctcatatctattaattaaattcttctagttagatataaaagaaaaatgttgttcatgttacctttaggtgatgtttgttaccaagagaaatgttgctgagaaaatccctgtctattgtactagcagcaactgtgaaggaccagggtgccacatttgtgacagttctagatgcaggtccatcattgccagcagagctaaccacgactatatttctagtaactgcatggaatgctcctatggaaaccccatctgtgaagaaagcttcaatataaggattggagccacccacagaggcagaaatgacgtcaacaccatcgtatacagcataatcaaatgcttgtagaatatctgcttcatggcagctaccagcatcatttgtagaccaacacactttgtacgccgcgacacgagccttcagggatccaccctttgcagtgccattgccattgccaaagatggttgcaccaggaacaaaattaccagcagcagttgacagggtatgtgtaccgtggccaacaaagtcacgtgcagtgcgttttaagggatcaagtttgccatattgtgcctcgtaagcttcactgaagactcttgctccaatcaacttcctgattcatcatcatatagcatagctgtgtattatctatatttctttttcttggtgtatttaacacacaaacatataaaatgcttatataaaacagatccgcaaaagtcagtggaaatagaaagtgcatattgggcttcatgtatatatatatatatatatatatatacacacacacacacatacatactgtcacatgctgatgcacacacaaatgtgcctgctttatgcatgtactgtcacatatgctaaggaactttttcatttgcttacaaatgtttttaattaatttttatgtatttatttagtagatttagaggtttgaatttataaattcttacaaactactcagattacactaactttattaacattttaaaactgcacataattaatcaaagattcaaagtttttttttttttttgtatgataaaagatacaaagttatatatctctatataaatgtttcatttgacatgtctttagagacactggttattgagattaaagagacagacaaaaaatgtataaaatgacctgttacagaatgttttgtttgaaggtctaaaatggtcaatctgacagaccccgttcccacgccactttgatggcacgggactgtatccattgtcgttgaaacttatgtgttcgggccaaacgcctgtgcaacaagtaaagagtcagtaattcacttccaaccataccaaattaaagagatcatttctaaggtatataaatagctagaagtatatctgttcttgaaatttaatgaattaaaattataaagtactttatattaaatgaaaaatcatttttttcacatcttaaaaaagtgtgtgtatacttttgaagtgtggaggaagaaaaaagtgagattgagataattgatatgacgaaaaggaagaaagaaataaagaaaaacaaaataaatataaagattaagatgtaaaaaatgttcaaattaaaaataattttatatctttttatgatacgttcttattattataaaaaataaatatacttgatgtcttaaaatatataaaaataaataaatattttcagatagtaattggtaacattattaattaattcagcacaaaaaaaaggaatatatattgttgataggaaaaaatataaaattaaaggcaatagaaatggaataacacatcttccgatccattacattctttctttggcccaaaaataaataatgtgtcagaaaaagttatagaaaaacatgttgataaactcttccttatctaagaaacaaactcagtttagatatgccatatcccaaatctcttgtattaagagcaactaaaagtttagtgtacctgaatcaaaattagcaatgattgtattttcgccgaagtttccgttccaccaagcggattctgcaggaattcctccatatttttccagcccaagaaagtcccatgacctggtagtatgcaatttatactctttgctcaagaaaacagaaattacacttgccttttctgcaccaatagatccaaacacatatatgcgtacagcatcaaaatgcgtagttataatttatatataccgaagatctaaaagaaaccatggtaatcatttattagctcacttccaatctctgacgcctcttcctcttcaagtagtgctgcaaagccattgatgtgcttattgtacgagtacatgactgcttcctttgctttctcatggctatgaaaataataaacaaacaaaaatattttagtcatcaactagttagcgtcacagaataaatatttttttttataccataggattgcatggaatgagagcgagtccaggtagaggactcagacaaaacagtaaaattgtgtcttggtgatttatggtgtcaaagtatgttagctttttcactgagacaaatctccttcaaagatttaaaaggtaggcaaaggttatttggtctcttccaaccaatttttctttacatactatagttagaattcgaactaatacactagattttatatataccttcctaagactgttgccagtaaatcaaaatgggaatttgtggctgactcaatatcgtgaagtgaaggacttggaccatgagaatgctctcccaagtatacaatgtaggtctgctaaagagaatcaaatcaaagcataaatatgtgaaaaatagtatatccaacagcaaaatgtgaattttgtagttgaagttatgtgaaattaaacacagacaactgtattagatacttgcctttctaagagcatgtgtgtatggctgcaacatagtgcaaagcatgattgatgataggagaagtttgaagagggaggatgcagccatcttcaactggtttaatcttctgggagtgctgataacgcgcttccttatataaatcttttcaccacgttttattagaggcaaacatggatcttatgccattctttgtccttaattattcccagcaagtacaacgtaattttggaagggaactgagttaaactctcttctcctttttattaaaaatgaaggtttgcacggactaggatcacatgtagagtgtacaccggagtccagaaaaattgcacagttctgactcctaacgttgcatccaatttatataatgtaaatatattttctacgttcaaattatatgaagaaaacattttttatggcctatattttgtgtagttgtttatacaaatgtagagtattcggatccactatttgcttatttggtatgtagttaacagttaaggatacatttgacaaaagaaacccgtatataattgaaaatttagaagtcggctgaaagtttataaggtaaaagttaagaattaaaaacccgaaaatatataaagtaattgattgaactcaaagtgtttggtgagtttagctacgctacgacaaaaatgagttttggtggcaattaatatttcttttaccgacaataaaaatggctacgaaacgttttaccgacaatatgtcattagcgcgccattgtatcatgcttgggctggaaatagaagtggtccatggcgccaacaaacattaacagaaacttaaaatatctaattaaaaatatatttattttacttgtacgccttgagataaatctatctaattttacctggattaattagttgtgaaaaataacaaataattataaatataatcaattatatgaaataagttggccaaaattaaaatttgatcctcttatttttctcaatatgtaattttaatctccctattttaaatagaagtatttaatccttttatctctcaattttgcttatatttactcgtaacctaatgaagtcaaacatcttggtagccgcggaaaggtttcatgaagggcacctctatttgtcatctcgatctccttgtcatatgagttcaaagttatccaaagtgtgatgagattttattttttttgaataaagggagcttagcagtttcccaaactcaaaaaccacgatggaaaaaacaaaactaatattaacattttagtaaaataaaggaagatgaaatctggaacaacattgaaaacaagaatatatatatatatatatatatatataactagtagataatatataaaccaaactttgtcatgggctcatggcatcatcacattgatttacttcatgagaaatgtgatcccattgaaaaacaactcccttctctctgtacgaggtgtggatctgggccaaagcatatatagcatgcatgagatttatttctagaggagattgatcgcctaaattaaagagtcagactctgaagatattacgaatcccccttttccaaacatgttttatttcgtacaacatacccctaagctcagcatgcaacatattacactctcccagaaacgaagcataggctgcaacaagtgaccattatggtcacgtacgtaagatgcttccacaagcaacttgtttgctatggaggttgcatgcactaccttaattagtgttagaaatttgggtatgataatcctggataacttcaaagaatcgtgttcgtacactttccgaacaaagtatttcgaccctattcttgtctgggttcacgaaatccttgttgggataattcttgaagaacaatctgcttctggcaatagagaacagatcaggaatgtagagagaaagtatgattttcgtatattagaaatctgaggccaaatgactccttatataggagtttttccaaacaatacaactcttggctgttcggcttttccaaacattgcaactcttgacgatgaaccatcgtaaccgttggttatcagaacggttgggagtagttatttttctaacctttcccaagagcggttaggagtagttattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattattttgaattgttaaccgcctcttatttataacccatggagtttaaacaaaaactccaacaatcccccacatgaataagagatcaattcaacatggaaccccgcaccgtaatcgcggtcaattatgcgttggctcaacaagtgtgcactccgcactaccctaactcgtttccaaagcttaacgcgtaatcgcattggcctatagtaaatcacattactactaaaatccattgatgacactaaaatcaccaacaaatccccccattttagtgtaatccttgatctactcagtataacgatcaaacaaatgcataaatgaaatgtcttgcgattgaatttcatcttagtacaaatacacattccatatattcaagaatcagggtatcgttacgattgaacccgtcaacttatttgaatatctgaagatattgtacacacatgttttctacaatactctactattcatacttgacactttacaagccatgtgtccttatccattcgtaagcatataggaagccaaatccaaacttcttgaagcggcaaaacttcatgctcacataggtgatccttttaatcttgtacctgcttttacaatttttcaaaagaaccattaagaagatatacttcaacctaaccatcacttgcaggtctgagcaaaaaccttgggaagacaaacataattgctccaatctctaactataatctttccacattgaattctgcttctaacgttgtattagaagggaattgggtatatcataattagaatatttaaatggactttaatcccatccctattaccgacttctttactaagtctctagctaatcccttcgtcaagtgatcagctaagttttgttgcgaccgaacaaactcaatggatatcaccccattcatgattaattccctaatcatactatgtctaacacccaagtgtctagattttccattgtgtatttgactatatgttttagccaaggtggcagcactatcacaacggatagaaattggtgatatcggtttaggccatattggaatctcatataccaagtttcttagccattccgcttctttaccagcagcagctaatgctacaaactcagattccattgtagaactagttatacatgtttgcttcttggaagcccatgagatggcacctcccccaagcaaatacacccatccacttgtagaggatgaatcttcaacattatttatccaactagcatccgaataaccttctaacaccgaaggaaatcccacatatgacaatccataatttatagttcccttcaagtacttgaacaccctggttatcgcatgccaatgatgtctactgcggttactagtaaatctgctcaactttccaaccgcataagcgatatccggtctagtgctaatcatagcatacatcaaagagcctattgctcttgaatattcgagttgatctacaggtttacctgtatttggcataagattttctcccggatccatgggagtatttaccggagaacaatcttcatggttaaacttcttgagtatcttctcaatgtaatgagattgtgtaataacaatccccttattctcccgtttaatcttaataccaaggataacgtccgcttctcccatatctttcatggagaactttgatgacaaaaaattcttcgtattattaacttgattttggtcggtgccaaagatcaacatgtcatcaacatatagacaaatgataactcctttactggatttatcaaacttgctatatacacatttgtcagcttggtttagaatgaaaccactagacaaaacaatctcatcaaacttttgatgccactgtttcggagcttgtttcagcccatacaatgacttaactagcttacacaccttatgctcattgccaggctttacaaatccttcaggttgcttcatatacacttcttcttccaaatcaccattcaggaatgctgttttgacatccatttgatgaatcactaaattgtgaattgccgccaaggcaatcaacaatctaattgtagtgatacgagcaactggagcataggtatcaaagtagtcaatcccttctttttgtctaaagccttgaataaccaatctagctttaaacttgtcaattgtaccatcgactttcatcttccttttgaagatccatctgcaacccaaaggtttacaacctggtggtaaatcagataatannnnnnnnnncttggtacatcatttaagtgatcatcctttagagattcatccaaaatcggtatagagttctttggtctaggcgtagaagagaagcaattctcatcaaatatcgcatctcttgattctataattgtgttaatagaaatcgagtcattaggttctataacataaaacctataagccttggaatgctcagcatatccaacaaagatgcaagcaacacccttttcacccaaagttttccttttagggtctgggagtctaaccacggccctgcaaccccaaacacgtagaaatgttaagttaggtcttttcttataccaaagttcatatggggtagtcttattccttttattaggaaccctatttaacaaatagcaagccgttaacatggcttctccccaaaacccttcactcaaaccagagtaagataacatggcagtcaccatttctttaagagctctattcttcctttcagccacaccattttgttgaggtgtataaggtgccgtagtctcatgaatgatccctacggattggaagaatgcaggatcataatattcaccacctctatctgttcgtaatgttttaatcatcacatcttgttgcagttcaacttcagttttataaattttgaatttatctaaagcttcgtccttagtatgcaacaagtaaacatagcagaatctagatgcatcatctatgaaagtgataaaataccttttatgccctaatgatggagtagcatgcaaatcacataagtcactatgtattagttcaagtataacagatttccttgttatatttttaaaaggttgcctagtgatcttggttaatatgcaagttttacacttttctatattctcatcaaaaacaggaattaaatcatctttagacatttcacgcattcttttataatgtacatgtcctagacgagcatgccataaagacgaattgataacattcgaaatagacataaatacagaaccagaatcattaggaactccattcaaattcatcataaacataccattattataatatccaaatcctacaaacacaccagactttgatagtacaaatttatcggactcaaacacttgcttgtatccaagcttatttaatacaggaccagaaattaagttcttacgtaatttaggaacatatacaacattaaacaaagtaatagtttttccagaactgaattctaacaccacgcttcctttgccttcaataggatcaaaatgatgatctcccatgtagaggacagaaccatcttccactggaacaaaagtcttgaaccagaaacgatcagcaaacatgtgttgtggcgccagaatcaatccaccacgcgatagcatcatcctgcacataaaatgcttcagaaattagtgaaaccgaatgtttaataaaacaattcaaatcacaaattgatttctgaccttcgttttgggattggtccttagacccttttcccgaaccacttgcattcgcgttattgtgttttttcccataacggcaatccttcttgaagtgacctgttttaccacacttccaacattctagttttggtttcagtttggagccgaaatttcctttggtgttcttgaaagcacgcttctttcctttgtttctattgttattgttcttaccgccctcttcgatcatattaatcgagggtccagcaacttcttttccttttcccttgtcaccctccagcgcccttagagattcttctatgcgcaagtgacttccaagttaaaccagagacaagtcatcttttccatgcttcaaattgtgtttgaaatccttccatgaaggaggcaacttgtctatgatacttgagacagatattgtttcatccatcttcaatccatgttgtgtgaattgtccaaggattcggaggagttcattgaattgttccatgacagaccttgattcaaccatcttgtaattgttgaaatcagtcaccagaaactttttactggacgagtcctctgccatgtacttggattcgagacaatcccacaattcctttgcagattctgcatttgataaatatcaaataaggaatcagacataccgttaagaatgtgtcctctgcatatgtagtcgtcgttctcccactttgatctgcgccttatattttcaacggtatcttcctcaagaagttctggaatcggagtagataagacgtacaccaccttcaatgttgtcaacatgaaatgcatcttcttctgccaacgcctgaagtcttgtccttgaaacttgtccaactttccgaaattagtagtcatgtccttgactgtgcttcctccaacgcttcctccatccatgattatcagaaaatactttgttcgtttgttagaaatttgggtatgataatcctggataacttcaaagaatcgtgttcgtacactttccgaacaaagtatttcgaccctattcttgcctgggttcacgaaatccttgttgggataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatatatatatatatatatatatatatatatgtatatattttttggtaagttggattgtgtaggtattaggccaaagcagtggaaaaattgttggtatctacctaccaacgcttagttcaatgagaattggtaattatatgaagagtacaatatttaatatgggtttcatagcctctatgatgaaaagagacataatgacattaattttgattgtttggatattcaaaatgaaacaaattaattttatacagtattttaagatgaaatgaaataaaaatccaattttatttaaggtgtgtttgattgtgtttttgttttatagattttaaaaactaatttttagtgacaagtgaaggaatatggtaaagtacaagaaagaacatgaataacttgaaactcaataaaaatccaaaataacttgagatattttggatgggattgatttttatttttaaaaattacttttagttttcaaaatctaaatataaaaaaatatatttgattttgaaaattctacggatgtgtttggttgaggaaaaaaagaagtgaaatagaaaagaaattatgtgagtctcaaatcttctacactttaatttaaaaaaaaaaaaatcttttatttctatcctgtaaatcaaacacactgtaaactaaaccttaatagaaattttgtttgcacgaatttgagcttgtggaaatggatggagtaggtggtgacgactttagccttggaagcattgagatgcttggagattttagtggcaatgtaaaagggattgaccatgatgatcggagtggtgctgcaaatgtggagatgaccatgaatgagaacatgaacttaagggagctctgacaggagaatcacaatggtgtggtgtcacccattaaaaactaaaataattttaaaaacagttttcaaaaactattttttaccaaccatgtttttcttttctaaaacaaccagttctaaaaaccatgaaacaaacagggcactgagctctttaccataatttcatatatttatttttgtattcattttatctcatttcatttcatccttacactccttggaaatattgaaagacgaaagaacagaagaaaaaaaatcataaaataatacctcctccatttggtaattgataaataacaaaatatttatttgtcaaacctttttcttaacatatataactttttatgatttaaaaaattgataataaaaaaaacaaaattttattggttggcgaaaaagcttaaactttaattatcatacccttgggcaaccttgccaccaaaccacctaaaaattatctaaatttattatactctttccttcttttccttttctttccttcaactttcttgaaccccttactaacacagtcacactcctctaaataaaagaagggaagtagactacattaaaatatatatatatatatatatatatatatatatatatatatatatgttgaaggctatcaacctatacaatatgtctagcaaaaaaatattctaggctttagacagaggaatcgtttaataacatgtggtggcattcaaggcttcagtcagagtcatcatttcatattattccagctcaacttcagatagtaattttgttgcaaaataaagactgtcctcggagccaggcatcagcattttttatttttcgatttgggcttgtaacacctttcagtcagcaatttccttttttacctctaataaatgcaaaacctgctctgctttctattaatgtttgcaaatgaaatatcaagaatcgtacgtaaacaaaaagatgctaaatcagaaggacaaagaaaactatacagtaaattcactaaattcagttgttgttgaggcatgaaaatcttggaacagaactcattactcattagcaagtagcaattattgcatctagggatcatggaccaaatgcattagaatccactgttggaccaagatttcacatgcggtccacaaaaaaannnnnnnnnnaaaaaaaaattaaattaccattttaccctcatacctctaaatttaccaatttatcctcatacttcctaaaatccatataatggcccctagacgcagaccagttcacgaaactataattgaagaattgaggcaacaaattgaacagttgcaagcaactgtaaatactcaacaaatacagctagaggagcaaagagcatcccaaagctacgattctgaaagtagtgattccgcatcaaccagcaatcgtcgaacgcaaagacaagccttccgatcagacgatatcagagtagaaatcccagaatttgaagggaagctacagcccgatgattttgtagactggctacaaaccgtagagcggatattcgagtataaagatatacctgaagacaaaaaggtcaaaattatcgctctcaagttgaaaaagcatgcttccatctggtgggaaaacttaaagaagaaagagcaaaggaaatcaagaaattacatgagcacgttcgtgatcagatccagaagcagaactctaagtataaggctcaacgagataagcatcgaaagttacaaactttcaaggaaggagacttagtctggatccaattacgaaaagaacgatttccaaatcagccaaatgccaaattatctccaagagcggatggtccgtttcgggttgttcaaaagatcaacgataatgcttacaagattgagctacccggttcttacggagtgtcaactacatttaatgttgccgatctctcaccatacttcaaggaagaagaattcttagactcgaggacgagtcttttccaacctggggagaatgatatggaatccaactcaccaagactcccaccattatcataaggctcccaccatcatacctttcaccaccaactcacctccataattcaagttttcttttctttatttaattgtaccactttctttatttaattctagaattactactataaataggagtatcatcaagcattgtaacacacaacaattcatttgaatacaagaacaacaagttcttctcttttctctcttttctctctagtccttttagttcctgagccattgtccttgttattttaaatgatgaccgtatcattttttatgatattttaattttgtttatgtagcacttgatgatatgatacttgacgaaaatataacattccatttggtaagagcaaatgaaaaagagtggattaaaataggatagtgatagagaagagagacaaagctagaaaatatgatgaaattttttagtatgagtgcattaaaataaattataattaaagattatcttaaaatatattaatgatgtagtttaataatgtattcataataaaaaaatagaaatatgtacgttaacaaattcatatgtaaagagagagcaaaagaacgaataatgtattccaaaaataattttaaaatgttactctatcttaatattttcttgaaatttaatagttaaaattaattattcaatataatcattatattttaagaaaataaatgataataatgacagtaattctaaaagactaaaagagtagttgcttttagaataagttaatctctttatatatatatatatatatatatatatatatatatatatacacgctgatatacatataactccttttcagttggagtgagtaattctagatatttagttaaagaaaaacaaaatagtcgattttctctcctccgtaacaatcgtttttaatggtgtcatgagccacattgcaacgccgatctgcacgtttggtgttctacttatgcgcaagcatgtttgagagcgacaacggagaacgaataaaatgagaatttgagtggattcgaattgatgtgttgcaaccaatttaacactctgattcacatactgaaaaattaaaatgtttatcttcagtgactggggtctgggaccttctcttctatttgtaccacataccttatgcaacaacatatttggagtcattgatagtgatttctctcaaccaaatcccaccaacccataaaaataaatgagaatttgttttttgtttttgcaattggagtagattgagaaatttattatgcttttctaatgtagcacagcgtaacaattgaaaatacttacaattccaccaaattgtatcatttgttaacaattgatctgattcactgtataagatattattatgagcacaatttttgcaatgtgtatactgttgcagccagtgagatcttgacaggggtggttgggtgggagaagacgaagaaaaaatagaaaagaggggatctgtttccaaaaacgtgaaagaggatgagaaattaattttttattatctagaaaaagttaaaaggtgaattacagtaatattcttaacttaaaagaaaagaagtcctaaatattttagcgtacattgttaatacaattaatccaactgaaaaaagagtttatgtatattggcaataaattcgtctgcaatatattgttgaagttacgagttaggaaattttatacctagaatttatatatttaactcccatgtatatatccatatcttgcaaatgaatttttgcatatctttaaaaaacttgaaatataagtatgggtgaaaagctgaaaataataaaaatgggttcaacacacactaaacgcatttatgagaacattggttttacataggattgcaaatttgcaatgaacggaaccaacttaaatataattcaagattcgatttcataattagttcgttaaactggattcataaaaatgcattaaaaaccacacaaacatgcattaatgtatgtatatatatatatatatatatatatatatatatattaaataatatattttatattaataaattcatataattgatttttttcattagttccatattatttttatttttgcataactaaataaatataaaataagtataatttaaatcaatttgagttaattagttaggttgattgtgatcttgaattgagtcacgttccatatatatatatatatatatatatatatatatatatatatatatatatatatatatattnnnnnnnnnntatatatatatatatatatatatatatatatatatatatatatatatatatatatgtatatattttttggtaagttggattgtgtaggtattaggccaaagcagtggaaaaattgttggtatctacctaccaacgcttagttcaatgagaattggtaattatatgaagagtacaatatttaatatgggtttcatagcctctatgatgaaaagagacataatgacattaattttgattgtttggatattcaaaatgaaacaaattaattttatacagtattttaagatgaaatgaaataaaaatccaattttatttaaggtgtgtttgattgtgtttttgttttatagattttaaaaactaatttttagtgacaagtgaaggaatatggtaaagtacaagaaagaacatgaataacttgaaactcaataaaaatccaaaataacttgagatattttggatgggattgatttttatttttaaaaattacttttagttttcaaaatctaaatataaaaaaatatatttgattttgaaaattctacggatgtgtttggttgaggaaaaaaagaagtgaaatagaaaagaaattatgtgagtctcaaatcttctacactttaatttaaaaaaaaaaaaatcttttatttctatcctgtaaatcaaacacactgtaaactaaaccttaatagaaattttgtttgcacgaatttgagcttgtggaaatggatggagtaggtggtgacgactttagccttggaagcattgagatgcttggagattttagtggcaatgtaaaagggattgaccatgatgatcggagtggtgctgcaaatgtggagatgaccatgaatgagaacatgaacttaagggagctctgacaggagaatcacaatggtgtggtgtcacccattaaaaactaaaataattttaaaaacagttttcaaaaactattttttaccaaccatgtttttcttttctaaaacaaccagttctaaaaaccatgaaacaaacagggcactgagctctttaccataatttcatatatttatttttgtattcattttatctcatttcatttcatccttacactccttggaaatattgaaagacgaaagaacagaagaaaaaaaatcataaaataatacctcctccatttggtaattgataaataacaaaatatttatttgtcaaacctttttcttaacatatataactttttatgatttaaaaaattgataataaaaaaaacaaaattttattggttggcgaaaaagcttaaactttaattatcatacccttgggcaaccttgccaccaaaccacctaaaaattatctaaatttattatactctttccttcttttccttttctttccttcaactttcttgaaccccttactaacacagtcacactcctctaaataaaagaagggaagtagactacattaaaatatatatatatatatatatatatatatatatatatatatatatgttgaaggctatcaacctatacaatatgtctagcaaaaaaatattctaggctttagacagaggaatcgtttaataacatgtggtggcattcaaggcttcagtcagagtcatcatttcatattattccagctcaacttcagatagtaattttgttgcaaaataaagactgtcctcggagccaggcatcagcattttttatttttcgatttgggcttgtaacacctttcagtcagcaatttccttttttacctctaataaatgcaaaacctgctctgctttctattaatgtttgcaaatgaaatatcaagaatcgtacgtaaacaaaaagatgctaaatcagaaggacaaagaaaactatacagtaaattcactaaattcagttgttgttgaggcatgaaaatcttggaacagaactcattactcattagcaagtagcaattattgcatctagggatcatggaccaaatgcattagaatccactgttggaccaagatttcacatgcggtccacaaaaaaattggttggtagtgttaaggaaaagtagcttttgttagtcctaactcatgaatgctggaatgtgcaactccaacaaaatcttacctaccctgatcatcttcattaagatcaagtaggtgggaaaaatctattgagattgaatggcaaagtatagaattcttcatttctattatctcctttgaatgttctaaacttcacccaccatggcatccctcgatctttctttgacctttctacctcaagagtgttgtcaagaaacactgccactatcaaacccactgttggaggtgatgagaataaggtatttaagaatgcattgaactgcaaagatgaaaattttgcattaagagcaagtaaactactaaaaggctattgatgttgacaagtataaagaacaggttaggttacatatcaaaacaaaaattgaaagtataaatttcttgaaagaagtctaaaaacaaataacatgatggtaacacgttagttgataaagcataatatagatggctgaggaaaagtacaactcacccatccagcattagtatgaacaaggccacgtcgtgagggagtccagtattgattgaaaaattgaggaacagatattccaaggaaaagtgtgactccaatgataataagatttcttatggagttcatgtttgtgaactgaagaaacgatattccaattgaagctggtgaacaagggaaagtaattgtaaatagatgaacaagagaaaatgtattgcaatcaaatctcagttcagattacatgacatacccacaaggccaaagagaatacagtatagtgcagcaaatattgggaagggtatagaagcaaacaaagctccaaattttcctacagatgatgacagaaaaagaaaacaaaaaaaactcaggtaagtgaaactatcttttctcgtttataatttatcagagtaaaacaatttccatgaataacatgatgaagaactggtttacttctattgtaatccaggctcatcttcgatttgtctctaccaacctaaaatagagaagaatatcataaagccagcagaaatctgaacaactctgcgacttccaactcgggatagtccaaggagtcccacattttccctagaataaacaaccatgatgctcatcaagctactatagaaagatacatggatcatacacaagaagctgatgcagttaaaactcaatgaagagttagacttacacagaaacagtggaaccaatcgctgttccataaagaccatcaagtaagacgccaatcccctggataaaataaacaatcagttccatctctcaatcatatcaacctctacagtatttttaacttttaatgactggtcacgggattgaagtcttaaaactattcaaattaatacacaggcataagctaggcaattcaataataataaatgacttgtgccttgtaactaacctgccaaccaatgcctcgacttaatacatatgcaggaggtggagtagcaattgctagccgagaggccgccatgtatgcaccagttgactgccacaagtgcatggtcaagatgtcaagacaatatagaaaattcactaaaatacaatgagacaatttatggtgattgtaatcagtattttgtttctttagtcattgtggattttttggggcctgagaccccttggtcaaattttaaaatatgaatctgtagtaacaactaacaagtactgggatagaacatacaaacactaactctgcaggtgagactgaagtcaaacagaaaaaaacaaaatcaggaaagaaaatagatacctccaccattgagacaataactgctgacatcatggcaaatgaatggccaacagaaaatgtaggtggaccccattggaaaggatatgggaacatgaacctagtacaagaagaaaaaacctcagaaataagcaaaacctttgaacctatcagaagaaattagaacaggttttttcaggtaccatggggcagttgatatcagatttgctctgtctgttctacagctatgttgtgttatgtcaggcttgtgtcggtaagctccactggcggtcaagataacagcatagatccaaacaaatgggacacaaatcaacactggaaaacgttcaaatatagggatatctctaaatggtctcacgtgctttagatactgcaatttatagcaaaattgtttgccttagggaaagaattataatttgatgcaaaccacaattttctagttagagcacttacttgtgacaaaccaattaccaacaacagcattggtataccaatttctacacagtcccccaactgaaaatgaaaataataaagaacattgagtaaatttatgatgttatgaaacgtatggcatccatcaagctatagtgagcatggtcaattacaagattctgaagaagaaaatgccatcaatatttgcatgcaacttaagcattatgccactatcaaataattcagaaatatagttagcatgttgaatgaaaggatttttctacagaaaatgtcaccaatatctgtatacaaattaagcatatgccgctaccaaataattcataagatgaaaagtagacaaaaccctcaatccatatataatgaaaacaaggatcaaattttagcaatgaaaattggattcacttaaataggtgacaacttggagataggattcaagataagttccttaaatattaatatttatcatcattcagaataaattgctgtcaatagagagaccatttcgtcacaattttagttgagatcatgaaaattaagatggagatttgagccacacctaccacagggaatccacgttgaaataatcctaatccaaccaatccaactacaggtgccatgccaaggggactgaaaaatctggatagaagatccacaaaacaaaaatgcttcaaaattttaattaaaaattgtcaactcataaacacgtgacatgatactagtataccttgaaaagagtccccagacctggctgtaacccaagattatctgaatacttgatgctacaatcaaagctccttgtattgctcgcattgtttgtataaatctctgcaaaccaatcacatggaaagatctcttaaaccaaaaataagaaagaaatctaactgtgtttctaagaaagctagtaattgtaattagagagcctgaggccttataaacctcctaataaaattccataattccaatgtgggactcaagtcccatatctttcaattggatcataacatcccaccacactccacagaacccattcgggatggcagtgtactagtcctagaacaacactgcaatgctgatgtcactacatgagtcgcttgtttgcagctgagagacatggtggaaagctttgacaccaacagataagaaccaaatcagtacagaggaaaatatagtgatcaacaaagaacagttggacgtattattcagtgggcttttactctgatcaatgtgatatagaagaagatgaaatacaatgtattagtccacagggtatcgagatagccaaatgttctcccctgttccaaccttaatttcattccaacctcattctttccctcctactcctatttaacctccccctcccattctaactgctcctaagtcctaaccaatactgaccaatgaaatacattcaattaaagatggcaaaatcctctgtgctgcctgtttcaactggtgtacaccctttttattattgatctcctatcaatccccaaattatatgtcatcgatccaaaacaaagtccaaatattcagcagaagtttaaatcgtaaatgatagcaaaagtattatatgctatgaggaatgctagtaagtagaacatactattattggttgaaatttactgagactcacaaaatcatgtgagactcataactcattgaataaggcataggatccataagatttcgtgaattccaataaatttcaaacaataatatagtgtgctagaaagagcatgtcaaaaggtatgccgctagcatttttctttacactaaatttgaattttataatctggggctaacctattaccatttgacagaaaaccagtggattctcattttaaacttcactgacaacctcatactatggatagagcaaagttggtaaaaactaaatattgattttcctggtgatcaataattagcatatctacaactaaaatcccagtgtgtttcactcaagaacaatcattgaattttgtccagaataataaatccttggttatatgtttaggattgttgtgagtctaaaagctcccatagaggattcagtgcttatagttacatataggtatgcaaggttccaaaatcaacggaggacaaaggattatcattgcaaatggttattaaatgagttacaaatcaaaaaaacaatgtatagtttaatgtgctctcaaactactggtgatgaagaaatggaatgaggaaacttacttcatgagagtcactaatttgttgcaagtcagtgatgatataagcaattggatatatatacgcggatgaacctcctccaacgactgtaggcaatctggttccaaaaagcgtttggagaagtgtgttaatgccagctacaaaaagcagagtctgtattacccgtgccttgtcaccctggttatatcagaaccaaaacaccaacaagtaaatataagcaataaatgtgtggcaaaggcaacaattgttttacaaacaagcagaaattcagcatacatcacttcctcccatggcatgaacaatccatgacggaatcatcacactcgttcccagcatcaatatataattttgaaatgctagtaggatagcttcagctgcaagacaaggtattcacaatgagccaataagaaagagaatgtaaaggaaattggaaacattaatatcccacctcacagtctaaattgcactgctaaagtagatcacaacaactgaaaactcaaaattacttagagcaaatcaaaccattggttagaatacaagaaaccaagaactttatgccaaatttgtgtgtatcttgggcatacattcttttatgttaaattttcatttgaccttgttatgccaaatttttacaaaacgaaaaaatgtttgagtactaggaggttctagaggcggccttaggtgggaatattagagcattagcttcgcactaaagcaagtcacatagtaaggaatgcatgataatttcaggtcaatcgttctggtagatatcataaaagatattgttcttagatatcataaaagatattgtgcttaggatttctaaacctatatattaccttataatctgagtgcattgtagcgagtgtgtgaaaaaaatatagaggagaataactggatgtagcccacattgggtgaaccaggataaacattttgtgttatttttcttccctttctctttttctgttttctcgattgttgtgtaattgctcggtaccatcacctttccccccatttctttctccgttcaccactaaaccaaatttatatctcctccccattaccatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttttttgtaaagattgcccggcgaaatgatcccttagtattattcttgtgagtcattatcatatgaaaattgaaaggcttaacaactttgtttttattcattcttaatttaaagttttgtcatgttgatatatgtatagagtcacgctattacgaacgaaacgaataaaaagtgcatgaatttaacatgtaaggccgagattttttttttaacataaaatttaatcagagtaggtgctttgtagttcgtagcaacaatttcatcaacataaggtaaaaatggtcgattctcataaagtaatatgtaggaccacttattctgaatctaacgtcattaataagtataatttttttttcattaaccaggccagaagaagtagggtaaagtggtaattacaatataatggtcatgactcatgattgcaagccttcttagaaatagtgatcactatctcacagcactaaaggacatgttaaaatgatgatgagaaacagaaattctatatatctatttgaaaaaccagaatgttttaaattataatacacattttatgtttaaattaaaaactaacccaagtagaaaaagaataaaacagaaaagttcaagcttcaaagtcgcactctatctaaaatagcataaaaatctcaactttttaatccatataaccagaaacaaagtaaaatagcctagtctcaaacttttggagtaacgcgtacaaaaataacaaaccaaatggaagaaaacccagctcatgcaatggcttcaagacaaaaaaagaaaaaagctttctatcatttcatccatatgggtttgtaactaaagttggagaaactacaagacgggcaagcttcctctttctttaatttaccccctaatgatcattaagttcaaatccaaatatttaacaagcaccctttttttgcttataaaagaaaaggcacccttgtttcgtcagatggcaacagaaaatgatgaaaaggaatagaaaaaactcgtagattataataagagagaaaaacaaattagggagagagagcatcataccccaaggaggattagagtctaagcagcattcaaggtcctgaagctgttccatagggagatgggtaatgtctgccattgttgtagcttcagaagagaaacaaagaggtatcgaaagaacaaaaaggaaaggatgatgaggaagaaggtgaagaagaattctcaacaaagtaaagtgcaacaataaagtggaaaaaaaaaaaaagcataaatatttattagtcaaataatggagagtgaagtgtgcgtggaagtgtaacataacaccctcaattgtgatcgataagctagttattattttttggttttgaaattcgacgtggtttacgaaactagtccttaataaccgtgtatgaatacttgaataggaaagtgtggggggcccacaaattcccaagtggggtcattgatattcgactatgaagttgaagtgtccttactggggaaaccagcgaagcactgtgcgtcactatggtcccctgatgggactgtacggcacccattgagatgcataataatgttggtcgaaatggtaccttttgtgagtgaataactctgtttccatcgtcatcagatgcgtggaagcgttaaattttcaacttaggacttcaaaatgggcatggcaataaaaacatcaatgcatgagaatttgtttgatcggaattggatttgggttttatccgattcagaaaagtggagtcggcatttggtatgtcactctgaccctactatgcatatatttgtaattattaataatataattatacatttatatataattctattaatgtgtacacagatattatgtaattctattaatatatatatatatatatatatatataatttttttggtatcattgtccaagaaatcaaaaggctgttgcgtctcccagtggggtgcatgttccagtatgtgttcaaaggattcaagtgtcgctgataagttagctagcagtgtcttgtccctctcgtatttgtttaagactcttccagagagcctcctgtttttatttctttcttgctgcttcatgatgcagcttctttttctgttcctaatgtaattattttaatattttatcattattaaaataaagaataattattttaatgattaactaaataatattataattataatactaattaaataataaaactaaaaattttgcattagaataacaatataatataattcttaaatattcttacaatattgattctttattaatttttataaatattgtttgaattaaaatgtgattaataattaatctgtaattatttaaaatgtatgaataaataaatttttaaaaagtttgcgatgggtatcccaaaaaatgttcctaaaccctataaaagtcgataaagatagaattgggtttcattttttttccaccttttataaatccaaacgcattcttttataattcgaaattcattctgtcctttacaagaatgggaatcaaaagagttggtgaaggttggtgaaggttcaattatagaattattaacgcattaggcagacaccatagtccatatatttaatacagcctatcaagatatcactataatcaaccatagctcctttttttaagaggataaccatagctcctaacctcatcaaaaactatacaaatccacacattctaacccctttgtcatatatatatatatatatatatatatatatatatatatatataaaatgagtccaaataaagtcggataaaatccataaaacaaaaaaacttacaaatgactatcattgcgttaatgtttcccataatcatttattagatgttacaaactaagaaaacaatgcatagttgctctcagattgccagtgatgaacaaatggaatgaggaaatatataattctgtaggcagtcagtgataatataagcaactggaagagtacatatgcagatgaacctccaacttttgtaggcaattagttccaaaagtgttcggagaagtgtgttaattccagctacaaagagcagaatttgtattaccaagccagatcaccctggttatatgaccaaccaaatcacagtcagtaacaagttaatattcataaaaaatgtgtttcaaaagcaagatttgttttacacgagcagaaattaagcacacatcacttcttctcatggcatgaacaattaatgaaggaatcatcatacttgttcccagcttcaatatataattttgaaatgatggtaggatagcttcacacttcagctgcaagacaaggcattcacaatgaaccaacaaggagaatgagaaggaaacattaacatcctgacacagtctaaattgcactgcaaaagtagagcacgacaagtgaaaactcaaaactacttaaagcaaatcaaaccattgattaaaatacaaggaacttcatgccaaatttgtgtgtatcttaggcatggattttttcatgttaaattttcatttgatcttgttatgccaaattttcacataacttgtaaaaatgtttagtactagtaggttttggaggtggccttaggtgggaatagtacagcattaacatcgagtggaagcaagccaccgagtaagggatgcatgacacttttaggttgattgtgctggtagatatcataaaaggtaacccctatgcattctctttctagctagaatgacctccattgtgcatttaatcctaaattctttaactacatatcttacacattaatatataaaaattaggtgtaaggttatcttttatgacacctaccaggaacaaccaacccaaaattatactgattttctcatgtagtggctctcttcaacatcaatgttccactatgcccaaagcaatgaacttctcctaatcacaattaactcatttggttccggcatcaagttggcttatctcatgatattctacattttctccacctccaaactcaaggtgttctttatatatactcaacgattctataaggtatagacaactatgcaaaacttgtgttggcatgtcaaacacttgtcaaacatgccttaagcagaatggtggcgtgtcggtgtgtctatttgttggcatgtcaaacacttgtcaaacatgctttaagcataatgacgtgtcaaagtgttggtatgtaaaacacttgtcaaacatgttttgagcaaaaaaggtgtgttgatgagttagcgtgttggacactctttaaacaaatacttgtaaagtatgccttgaataggtgtgggacatcattttacattgacgcaataatttaatttttttaattagatatagctagaacatgagtcaagaaagtgagttgacacttgctcttaactaaatacttataaatgaccctatcatattttattttctgaagaagttaacttatattatattataagatattgtgaaacttgacattttgtaagactcgttatcatagaatttaatcagttattttaacttttaaaaaatatgatagtctttttatcttggaatccttttaaagattataatgtgaaataatcccttaatattctttttgttttctttaaatgcaaaatttaatattctttttgtgagtcattatcatatagataaaaacaaataattttaaatatgagagactaaaaaaaataatctaaattaagatactaaaaaatttgtactaacaatatatatatatatatatataaattaatttaaaaaaaatcatccaaacaaatttaaacattaaacttaaatttggccaaaagtatattttacttttaaaaaatatattcaaaagtcaaattcttccattaatttgtctcacttacatcttaaataaacatactaaaaattatattannnnnnnnnnacacaaccgtcttcgtatgtcaggcggtggcaattttgcaaataaactgatgtttacgaggacggctgaccaaaaaccgtcgtagaaaggtcataaagaagacggttatataaggaccgtctttgttttatttcatttttatattccttctttttaattaaaaaaccccgcctgttcatatgccctagtcttttatctctctcgcgccttctcacttccagactctctctttgctctcctaacctttcatagtgtgccctttgctcgaaacctctgttttgcctgtgccctggtttccgaatcccattgaccatgctttgatctccaaaaggtatgttccaagtattttaatgcatttcgtatacgagtttctctgtcaacttctgaaatcagatttccttagtggggctattgtgctgccatgtagatggagttgaatttccatcggattcatgggttaaacttaggggagctgattatttgttcttgccaagttagggtttcatgtttggtttattatgttaattactaaattgatattgggcttcaatggagggtgtgtgtttgattctcccttgaaaacacaaatctgactccctccttgtttccacatttttgctttggaaggtgtgaatcctccgttcaatagtgttgaaacagatttttgaacacaatatgtttgatgagtcatatatgattctgaactgtacgagtatataggtatggagatatattcaagacaaacatattggggtgtccttgtgtgatgatatcaagccctgaggcagctagaattgtgcttgtgacttaagcgcatctcttcaagccaacacaccctccaagcaaagagaagttgatagggccagaggctgtgctctttcaacaaggtgcctatcactccaggcttataatttttcttaattatttcattatgtgaattaagaatctaaagaaatttactttggtttcatctgatcagtatgcatttgaagtagctgcaatctcagcctttggtgaaataaaggagcttgaaatggaagaaatcagagagttgtatcgttggttggagaagggatacaacttctatccattacatgttcctggaacttcttattggaaggcaatgaaggtatgtaaaatgtattttattcttattatcatgtttaatttgtatttcttgtcctgttttgcatagtttgtacatttatgataatgtaactgagaactaaataattattgcaaatcgttagatagtatgaataattttgatacgaattgattacgagacatttttcgtacgaatcattatgagacaacgtggcagtattttatttagataagcaataagttaaaagannnnnnnnnnagtatattaaatttcatgataacgtttttttaaaattaaaattaaaaaaaattcattttaaatttaaagctaattatattaatttttataattaatatataaatactcatttaaatttatacggtgatttatatttggaaaaaaatgttggcaaaaataaattcctttcattaatctctaaatctaaaataataatttttttcatcgactaaagaatatttttaatacacaaagaaaaatacacattataatttatgaatattttgtgttgtcttacaacttcattgttaatgttgaacttaaggataaaataattcaatccaatacatgcatgtttattcatataccttttcaaagtgagaccgggaaaaaattattaaagctcaacttttacatacacaaaaaaaaatgttattagttttttatagagtaaaaatataaagtatattaaattatatgttcttaaatttaataaagaatatattagtataaaagttcaattaaaattaagataaatacatgtttgtaatataaaaaaaatatttataagtagatatgaattcctaaggtgtaaggggactagtaatatttattatttaattaataaaaattaatcattatttattttgacatcaatattttatatcatacttcaacatggaattttataagatggtcattaaatttcatttataaataaaatttaacttttttttttttataaacgagagatatggtcagacaataattgtgagaatctcttccaatgggaattcaaacattgttcattacgtgtgagagactaatccttttttctagatttaactcccgctagtttttaacattttttttttttttgcatagactatagacaaagtgtattaacaacttttttatcttatttatcaagtatataagttaaggaaatataatgagaaatttttgctgaaaaatatttaatattgatctttatgtaattaaaagtattgaagaatgtgtatttaatgcttttgaacttatgcacataagatagaaaaatatgtattaaattcatatttatttattcaacatagacaaagtgtaataacattttttttatcttataaatcaagtatataagttaaggaaatataattagaaattttcgctgaaaatatttaatatttatctttatgtaattaaaaatattgaagtgtatttatttaatttttttgaacttatgcacataagatagaaaaatatgtattaaattcgtattatttattcaacatactatcttatacttatatttgtgcatttttaccaaaaaaatacttttattagatttggtgatggtggtgttgtatttggttgcatgggtgcaagagtgatggtgactcggtgaaggttcagggaggaggtggttgagaaaggaagaagaaggttagaaaggcatattaaaatttttggaggtgcgtcaaggaaaaattggggtgtattaggtagttgtctatattcaattgagttagcccaatttttatacaaaactcggccttgttgtatacaatacgctgtcttgattgaaaacaaaagatgtatggacaataaaaaaaccgttatgggtccaaaatataaaaaaaggagtcttgatagttgaccccggttctcttctgtaatctttctgtttcgtattcctcaaaataataaagtttttatatgtttatatttcattataaatatttttttaaataatatgtgtattttaaaagatagataatattaatttacaattttgaataaatttaggatttaaaaaaaataaaatatacttattaaatattgtaattcattgaagtaatctattaaacattttgttgtatacaatatttttaatgtaatttgtatatttattcttttcattataattataataacaattactttagtgatgtggctcttgacaatataatattttttgtataaatcatattttcacaataaacaatcttatttaaatcgataggactattatgaataataaaaaattttccttttaaatattgatatagttgtatattcaggtttaaacttgaaatcattgattatgttaatatattttaatgtcaattgatgattcacacttttggtgttcaatacaatagataactaattgatatggcaaaatagagataatgttaacatttttttattactatttcaatcccataaacttgttatattttgtaaatattctaattaggtcaataactagttattaattataacaactatatagaagtgataactgttatttctctccagtatttttcatttgacatgtgatttgtatttgtactttgagtaagttggcttaaataagtactagtttgatatttttatccaccttaaaatattttatccttagtataatgttagtgtttttcgatcgccaacttgtataaatcatttgttaaattcatgtcatatagtttactttatctacttattattgtcaatgtaagaacatacactattgacaaaaaaaaaagtaaaaataaacacattactttaatcaattttcttttttaaaaaccaaaaccactttttaaaataagtttaatatttttattataaaaataaaatttttaataattttacatttaaattttgtaagatgacttataaattaattcataactaaatcaagaaaaggacatgtgattttttattgttttgaagttaattttccttcatcttgtttcaagagaaataaaatggatggtacaggggaaagaagagtaagggagcacggactctacgtaatcatgactttgatgaatgctatactcctctaacaagtgttcatattttgttctcaccaaggcatggatgtcatatatgtaaaaacactaatgctgaagttaatataagattatgagtataggtatagaggtgagaaatagagatacaatgttgtgaaattcgttggagagacattgagtggaattcgcttaagattggatttgctttgcataggaacagatcctcttctccaaattgtgaggcttgctttaaatgtatcattgtaatattaattttattttattgtgggattgatttgagaaactttgataaattaatttcttagttagagtaaaaagttgtctaagttacttagaataaaaaatgtggtgtggtgtgatattataaaaaacatataaaatattataaaacatttagtagagaaactcattaatttctccattagagatgccctaacccctaagttcccgagactctattccaattacaagttaagaagaaaaacttcttagaaataaaagagatcaatttttcatcgtatatttgattatcatttagtgttaaaaaactgctaaagctgtgtagatgtacaagctcatgcagtttagaccctgaactcttagtaataagatacttctgagtctaaaaaattgattactcacacaagtcggctgcaactatacaagcacacaaaatccatgacaaaagcaatcttttttcttctcattggaaactgtataatgttgaagtctacaccttctggaattttctccacaattattaaaatttggattttgaaatctgtaaactaaaaaatatcgaatttcagccatgaagtttcctatttgccaaagatctcgatttggaccacttgtacatgtgatgatagggttgcattggcctacacatacacattgagttagaacttaaaaattgtgctacgaaatgcaccgactgatatatatatatatatatatatatatatatatatatatatagtatctccccaagctcttcacaaagttgggtctgccccgcaattattttttaaatttaccaacccatttaaaggcagggtcttaacgtgtggaccaattatgaaccaaaccaagttcctcaccgccactttataaacacagtgaattaatgaaggcctaatttgatgtataaactttcattcttctatggttaataaccaaagaatccctacctattttagatttctaactagaagctaaagtacacttgattttgaaattacgaagacttagtttctgctctataaggtgacaatgaggggctggccaacttcaccctgaattggttcacatgtaagagcaagacactgtatttatttaattatatataaaggggttgggatatctaaaaaataattgcgagacaggtacaaatatgaactgttttctgttttcgaagatataaaacagtcggtgagcgagtaccatagcacatttctaattaagttctacgctaacatgattttagcctttagacttacccaatacgaacatgatctcataacatgcatgtatttgtggtccaaaactatatgttttacccaaaaaaaaaaaaaagaaaacttatctgagatttcaaaattcattttttttattgtacagattttcaattcaatgcttaagcctggatataaacatattaaataaattaaactacttatataaataaaagattaatttatgtgttttaatatttttagaaattctctgatctatttttttcttcaaattaaaattaaaatttataattgattttaatttataagaaatttagtccgtcttccttattttctttgtttgcaagtgcatgtgtattaaaaaacgtataaaaaaagtgtgtattaaaagtttattcgatttggaaatttttttgttgaaaaagaggttaattttgtagaagatgtagactactcatccctatagggtttttcataaaagaaaggaggagaggaagtgggttaaaaaatcagtatcttattattatacaagaaaacaattagtattttaatttttatcatgcttggtaatgtgtgtgtgcaactgacactactagaaatgttcctttcgacgacgcacaaaagaagacggttataacacaaccgtcttcgtatgtcaggcggtggcaattttgcaaataaactgatgtttacgaggacggctgaccaaaaaccgtcgtagaaaggtcataaagaagacggttatataaggaccgtctttgttttatttcatttttatattccttctttttaattaaaaaaccccgcctgttcatatgccctagtcttttatctctctcgcgccttctcacttccagactctctctttgctctcctaacctttcatagtgtgccctttgctcgaaacctctgttttgcctgtgccctggtttccgaatcccattgaccatgctttgatctccaaaaggtatgttccaagtattttaatgcatttcgtatacgagtttctctgtcaacttctgaaatcagatttccttagtggggctattgtgctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaattagtttacgagttttctaatttacaacttccatgctgtgcaaaatacagccatgcatatcacaaatatgccatttagatagttatataatacctgttctacaagaaattttaatttaaaataaaaataatgtaggcactaaaattcccattatagatgtgtgatcaggtgagagagatggatcctctcaacggatcttttttatataataataaatccacaatattttttttttcaattttattttaaaagttaattgcacttttaatttttttaagaatttatggatttttttaattttttattattttctgataataatcttctaccgaaagcaagtcgtagagatttaaacaattcaaactctgtggagttggtacagtaacgacaggtttgtgtaaattcgatttatcatgacaaaataaaacaaagagaattgaataattcatttattattattagagatgcatccattaatgccattaattacaacattgaataatcaaaataatttttatttatttcatgtctttgaatttgttttgtagaaatattaaataaatacattttacatttaatatattaaaaacgcaaataacgtgtagtatttataagtaatataatatatttaataaatgtattgaatgcttttgacctgtaccttgaacacttgtacctcgttattaaagattgaataataaaacttctgagaatatattagttaaaaatgctaaaatttgaaataaaattttatgaatttatttagcatgtagtgataataattttttacactatcatctattaataaattatcaaatataataaatttgttactttttattatgaatattttaaaagttacacatgaaatgattttttttattgattgagagtacataaaacacaatatttattatataaaagaagtatgtaatatttctttaaataattaaaattatttaatagaaactattaaataagagaaatcaatcttttgaattaatagcatcatattttaattatattattattattattattattattattattattattattattattattattattattattactgctgttgttgtaacttatttgaaactgatgaaaagagttgcaagctacacatgcaaggttcctgcaataagtcacaagtaaaaaacggttcttgtaataaatggagagaataggtgccttgaaatcacagtggaattttaacaagagtcaacatagcagggtgttttccttatttgccacacagatggacatccaagtgatgcaaaattcacccttgtgtgcaagaaaacaagtaaaagtggtggtgtgagtttcacgttctaattttgtggggctctcccccaaaatgatccctgcctattttagatacatcgtaggcacatctcaggcttttaaaagacaattcaaacccttcacttgtggtggtgtggtgtagtgtggtgagacttcacttctttttttcttccaatttcccttcactcctaaaaacttttttaggagggaaggggggcaatggaaccacataagaaacaccattttggaacctccaacatccccttgctagtacaacattgttgtcttattatcttcttcatcttcaccttcttcactaccaccaccacccaagcttttgattatgctgatgccctttcaaagagtcttctctactttgaagcacaannnnnnnnnntttttttttttttttcatttccagatggttgaggtagcaaaagaaactacacatctatgtggaaccacgtgtcagggttgagcttttgacagaatcctcacactttagctttgtagaaacttggaatgatggtaagcaattaaattcataaattgatcaacaaaattgcacagcttgttcactaaggttatctttggaggcattggtgtgttggttgtttctcttaaatgcttaattcatttcctgatttagtgtagtattagcatctgctcataattttgacatcaatgtttaaaaattttgattgttttttctcctttgacttggggttcaaccatgaaattaaatgtggtgcttggattcctttggaaaaattgctctgtaggtatcaaaattataaacacatgtcctgtgagtatcctgctgttttgcttacttattattattaaaccataaaatttatttattattattaaaccataaaatttattattattataaggggtgtgatataaaaaaaactcaagtgcatcatttattttgtgatttttatccatttaaaaaaaaaataatacatacaaagacggtttttaggcaaaaccgtctttgtatgtattattttttttttaaataaaatacaaacgaagacggttattaaggagaaaccgtcttcgtatgttgacatacgatgacggtttctccttaataaccgtctttgtttgtatttttttttttttaaattaaaatacaaacgaagacggttatcaagaaaaaatcgtcatcgtatgctgacatacgatgacggttttccttaataaccgtcttcgtttgtattttatttaaaaataaaataaaatacaaacaaagacggttattaaggagaaaccgtcatcgtatgtcaacatacgaagacggtttctccttaataaccgtcttcgtttgtattttatttaaaaaaaaattaataaaaaattagaaacgaagacggttctttggaaccgtcgtcgaaagtcccccactatcaacgacacccatatcaacgacacagcaacaaccgtcgtcgtaagccttaaataaccgtcgtcgtttgcgttatttgtagtagtgtgacttgttatcagtcaagtctcgtacactaaactagtaacttaatttatttattcagtgtaaattaagtctccatattaagacttaagttacgccatttacatgtagttgagatggtccgaaatctatagtaagttaatttatttgttcagtggaaagtctccatatcaagaaacttagacgtagttgagatgaccaaagcagaatgtagttcgtatcagaacagctgtcaccagtaataaggggataattacgtaaagaatattgtcatgatcaatggtgaaagcttaagggtttatttatggttacgtagtttatatcttgcactatttaatacattaataagaaattgtattaatttaagtatgaaaacaaatgagaaaatgtatttgtgttattttaaaaaaaatatatataataagataaagaatttttccttgttacataataagataaagaatgtaataaataattaaaaaatattaagttaatagaccttttcaactttaagttcctttcgcaatattggttattttacatttataatcaggtgttttttctccaataattcactccatttctcagattctagctagttaaaagtttttttatttctactttttctctaaaatatttaaaaaccaggatttttcttgaatacatttgattagtttacattattaatgactatatatatggtgtttggctacgaaattttattagttatttgatgtatgctttatttgtatgtttatcatattttgaaatttagttcattattaacaagtaaaaactcacaaaagaaaaataaaagaaatcacaattcccatttctagatttgttagttatttttctgttttatagttattttttcatttttattttttaaataattggtttgtaggccaacctatttaatcggaagctatactgcttatgcaagacagatgcaagaccaaaaatgaagtccatttttttcagttgaattagcttgttaaaaatgagagtcaataatgcagacaaacttcgaacttaatttaaacaggttgaaatgacccctttacataactctatgggagagtagagactaaggccacggttagtacacgtattttcatattttcgtatctatcatttaactctagctaatttaatttctttactaaaaaagaatccaaatatttaatcataaacaataatattattaaaagcatataattatatatgaagattttttttgggtagagaattatgtatgaagattaaagaagcacgcacttataattttaattaacaatattgtattttttgttatcatatgaaccggtcagtagctaatatataatttaattagattttaatccaacactaaatttaattaaacaaaactcaataatactttttaattaagatattattatatgtataattataatgatgatcggcatattttcccacaaaaacagattacctgagtacttgtgcaaaaataactgatggcgtggggggacaattctaaattctaataacctcttgatttctttatactgatggaaactttttttttccagtaactacataaaacaagcataaggaaaacatatattaaaaaaaaaggacacagattatgatggaaaagtaaatttcttatgtttggtggtcaaagaaagataatcaaatatggtaagtgttttaggtatattttattatttttcattctttcttcctctgcttttcaactctatgaaacattcacaccaccatgatcaagaagcaaaagcttcaatctttcaaccccaaaccatcgaagtcagatcacactcacagtcaaataaccaaaattccagtccctttcaagcatcttccttcgaatgacaccaatctgttcgaccctatttttgtgatttgatgtgtttctccttttcatgttcatcccattgttcccagtaaggctcctagatcatcaaagattaggttcacggtggctagtcgtggcggaggcgaatggtcgtcgtctttaatatcagcaacgtcgactcctggccttcgaaattcataagggatccctttagtaatggcacaatagtaattctatataaataattaaaataatgataatataaagaattataaatacaggaaatacttacggcaatcggttacattttctatgtgcatcatatacacaaaatatttgtccagcctgtacaaaaaaacaaaaccaatatttaatatacagacaactataaattttatttacagttatttaatcacaaattaataataaaataaatttgtttatttttaataattatctaaaaaattatatctatcctaaattccagacaagttaatagtgtaatctcttttgtattaacaaaatgtataaattattaaactcgagatttattaggtcatgaaataatcaacagaccggtgctgtgcatgtcatgatctggggaagaaaaaaagacacgattctaagaaaactgaatttgtcacgttttctttgtaagccttcttcagtacttctactcaaaatgtgataagacacgtgatgtttaatgggctgatgcaaacaaaacattcgaaggaacaatgacagcagcgtgggtttgagatttggatcttgcatcatggaatatattttgtcggtgcatgtcaagaagcaaaattaactatcgtataaagaatatatcatatatgtaatttccttaactcagtcctgtctttatcaaggtgaagttaaatctttcagcttagttgggtgtttttttggtaaagggaaagacaagaaaaatgttagtacaaggaacaggtttaaatgtgcattggtaaaggattagatacatttgacggatctaaaactttgtttcaatataaacaattgaaaataataggtttaaatatataaaattaaagaatataaaatatgaaaatataaaaacatgagaatagtaagttcattaaatatataaaattataggaaataaaatataaaatattagataattacatgtaatttttttaaaatgtgtaagtacatgtacatatcttcactataatatagatccgctattgtttgaatgagtttcttattattattatatatggaaagtacataatatgagactcttatgcaataaaataaaatatgatgataaatgggaattttaaacctagaatattaaatattatttgaatggttatattaagataaaattaaattttaatgtcttatctatattgtttcagtttgatcactcatataatttttttttaaaaaaaatactttgattctttaaaaaatttctataataataaattagttattttagtattttatcatactaatttggttaacttaaaagaaacatgataaactataaaaaaaaatgtcacattaaaaaatgggtgattcaagtaagatatgagatcagaaataatcatggatgggaagcgaaatgtcatcttaaaaaagcttataaggcgagttttaaaattgatttattgttccaaatgggaaaattcgttgaatggaggcacaataatatataaaggtgcatgcaagatcctagttcctactaactaggacataaaagtcatatttcacatgtatcataaacacatttaggttaagtgttgatttactaaaaagttaaaacagatagaataatactggacaaatagttgaatcacaagacaactttttgtattatacgttgtttagtaatcaatacataatataattaattttgtattgtatcttatttagagagagatgtgtagagaataaagtgcatatgaaaaaagaaaaaaaaagatgggggataataaaaagtcagaaaatgataataatattgtatttttacttttgataaatactagacaaaaagttatactgatgtttaatgagttacaagttttggattacttatcctattaatcattctttattttgtattatcttttagtcattttttcaaatcaaacattagacaaatatttttatattgtctagtccctacttttttagcaaatcacacgcacccaaggtgacaactaatgcacttcactaaaaacaacaaaatgagttaatgtttgaaataatttaaagggtgatatataatttcaacaacaaaataatttaatgttgagaaaataatacttattttgtgtgtgtcaacaatttccaataaagattaataattattttaacgggtcttattttataccaatattatgataaagaaaattaacatgaaagacatggattcaataattctttttcattaaattcaagaattaaaataaccatgcttattacatttagaaactgagtttaagattttcttatgtgttgtatatacatgtgtgtaagataatatgttttctcatgctttcgcattttatattttttctcacattcactcttatttgaataatattatcttatgaagtgatgaattttattttcctgatatagatctgatattttttttaggttgttaatatcaactaagtttaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaatattagaattgtaatataatttatatatttaaaaatatttacttattataaattataaattttaattatatgaaacaaacatttattttgtataatacacatgttaattaaaatattagtaaaatattaaaattagctactttctctgaacttaaatataagtaataattattttttactcaaatataaacaaattttcactacttttattttatttaataatacaactcaaaaacatccttcaattaattgagattctattttaatgtctcttttttattcttgatatcaaattctattaaaggatttttttaaaattaaatgtaattaatagattttaataatattaattaactttcttaattaacataaatattcattaattttatttatatttaaatcttgaggaattacaggactctatctagattttctccatattaaaatctttcgaaacttactctgttaatttgtacaccaggggtaatgctgttgacttactagttttattttcaggaacatggccaataacctttgaaatgcaattattatgttactttttaccaattcgagagtaattattatgtttctcgtgctgttacccctaatcttgagttgattggtgtaattaagaatcatcatgagcttcgtgtttgttcctagacattttatgcgcgctcattcttatctttcctttcggattgcgcgggaatacattggatttaaatttattttttttattaatgaaaatttcagttgttaatatttgttcttccgttctcaaactatagtattagtagatggtcaaagctagtgtatcctcattaaaaaaatattaattgatagaatatatttttgattaaaatattcttatttaatcctgttactaaaaccaccattagtaattaatatttcaatagtaaagagactagagactatatatatatatatgctagatgaagattcttattgatgaatcattagtgttatcggcttgaatacatgtgcctatatatcttagacagcaataaaaatttaatgcatgactaattgtaaacaaagatataattgaaaaaaagttgtaaatttaatcttagattcataaaatatcaatagttttaaaatatactaaaacgctaaaatgtctatagtttaggaacgaaaaaatcattaagtattattttaaattacttcctccatctcatatttttagttgtttaattaaggttaatgcccataaaattaagaaatacttaataaagtaaaatattgttatatttttttactaaaatattcttatttaatactatcttatctttgataattacattactagcagtgagtagtattagataagagtatactagtatttgaggggaaaaaattagactttgaaatttcaaaacagtaaattattttgaaaaagaaaaatagaaagttaaaacaactaaattcataaactctaaaatcaattgagttaatctaataatttttatgagagttttttaagagacatatatttaagacaatggcttacattctaacaccaaaaacaatcttgggaataactccttcattcaaatctgatcaaaatatacccgttatctctctaatgaattggatagacaactcattatctttttatttttatttttatgaatagacaactcattatctaatcttgcttgtaaataaaatcactcattacctaataaccatttatcaaatgacttcaaaaatcaatcttctcccacactcgaacacctcctagtgaaacaaattaatatccttccactacaatgaagttgatctaaagtagtcaccatccaactatatgcaatttaatatgcatatacaactttgagagcttcaagccacaatcctttttttattcaaccaaaaattgccaccttttttttccaattaagttttaaattgaaccaagagagatttttaaacctaagaccacccttgcactcttttttatacacatcttcacttttaacccaagaaattttcctctttgttctaccctgtagaatttttttgctatacaattttttaaaaaacttgcactggtacgtaattttaaaaaaggacaaaaaaatagagataagataatttaacattaacatagatataactattcatctgttgatggacttactaacaataaataatggaaggactaacttggtgagaaaatataattttagagattttttttgtaatttttgtctttcaaaaactaactcgttagcacctcagtttcaaagacaaatttaataatttactctcaaatttttcttataatgtagattgaaaaaccaaaagaaaataactggttaatattttagtgattgcaataattactacaatatcgttatagactatagttaaagttgcttgtgattttgttcctctctccttagttgttgtatcgtattgcagacgaaataaaggtgcgcaaaaagatggggcagagttctcatagactcatactcatgtagaaacatagtgtataacagaaactaacatggttataatcattatcatatcattagtgaacccttgccgatcatatatataaaaaaatcgagcaaaagaaaaaaagagggaagagctagaggaccaacatatattaataataatgattaaataacatattgtatgtggatgaaacttgcgtcgcacacattatgggcacgcgcaccataacctccttgcttcttccaaaataattttcaaacttctagtttttgcctgaaccaaggcctgccaaacgttatctcttaatggcaggcaaatcgcttttgatataagaaattgaccaactttagccataaaagaaccattttttgctcagcttaaaatttgtgcacattggcatgtgttagctatttacaaagataagaaatagaccaccctctgcatgcacaatgcaacatttatggagcctacttagcaaccctgaattccttagcttggcattctccaagactccaattagtttacgagttttctaatttacaacttccatgctgtgcaaaatacagccatgcatatcacaaatatgccatttagatagttatataatacctgttctacaagaaattttaatttaaaataaaaataatgtaggcactaaaattcccattatagatgtgtgatcaggtgagagagatggatcctctcaacggatcttttttatataataataaatccacaatattttttttttcaattttattttaaaagttaattgcacttttaatttttttaagaatttatggatttttttaattttttattattttctgataataatcttctaccgaaagcaagtcgtagagatttaaacaattcaaactctgtggagttggtacagtaacgacaggtttgtgtaaattcgatttatcatgacaaaataaaacaaagagaattgaataattcatttattattattagagatgcatccattaatgccattaattacaacattgaataatcaaaataatttttatttatttcatgtctttgaatttgttttgtagaaatattaaataaatacattttacatttaatatattaaaaacgcaaataacgtgtagtatttataagtaatataatatatttaataaatgtattgaatgcttttgacctgtaccttgaacacttgtacctcgttattaaagattgaataataaaacttctgagaatatattagttaaaaatgctaaaatttgaaataaaattttatgaatttatttagcatgtagtgataataattttttacactatcatctattaataaattatcaaatataataaatttgttactttttattatgaatattttaaaagttacacatgaaatgattttttttattgattgagagtacataaaacacaatatttattatataaaagaagtatgtaatatttctttaaataattaaaattatttaatagaaactattaaataagagaaatcaatcttttgaattaatagcatcatattttaattatattattattattattattattattattattattattattattattattattattattattactgctgttgttgtaacttatttgaaactgatgaaaagagttgcaagctacacatgcaaggttcctgcaataagtcacaagtaaaaaacggttcttgtaataaatggagagaataggtgccttgaaatcacagtggaattttaacaagagtcaacatagcagggtgttttccttatttgccacacagatggacatccaagtgatgcaaaattcacccttgtgtgcaagaaaacaagtaaaagtggtggtgtgagtttcacgttctaattttgtggggctctcccccaaaatgatccctgcctattttagatacatcgtaggcacatctcaggcttttaaaagacaattcaaacccttcacttgtggtggtgtggtgtagtgtggtgagacttcacttctttttttcttccaatttcccttcactcctaaaaacttttttaggagggaaggggggcaatggaaccacataagaaacaccattttggaacctccaacatccccttgctagtacaacattgttgtcttattatcttcttcatcttcaccttcttcactaccaccaccacccaagcttttgattatgctgatgccctttcaaagagtcttctctactttgaagcacaacgctctgggaggataccctataatcagcgtgtcacttggcgtgaccattctggcctcactgatggcctagaagaaggggtaggtccaaattctcaataatacccacataacccaactcatcaaattcttgtcttttactctcttggcatgccaattctctttcaaaatcaaaactttttttttctctctttttggtttgtgtaggtggacttggtgggagggtattatgatgcaggggatcatgtgaaattcggtttaccaatggcattcacgatcacattgctctcatggagtgccatagagtataggcaacaaattgaagatgcaggtgaactagaacacgcattggaggcaatcaaatggggcactgattatttcatcaaagctcacactagcccaaatgtcctatgggctgaggtacactaactacaagaaatttcaagagttttaattggtgttcttctcgagaaggcctttctcaatgtgtccaaattctttccactattagtatttaattaaaaaattaagtgtaccaaaaacttagatttctctggctaccatagcaattttctaattcaatcaatccaattcattattctcactgttttaattacttagaggcattggttgaagagattgaatggaattcaaaaattaatgagatacttttttttttccaggtgggtgatggtgacactgaccattattgttggcaacgcccagaggacatgacaacttcacggcgagcatttaagatagataagaacaatcctggttcagatctggccggagagactgcagcagccatggcagctgcttccgttgtgttcaggaaaaccaacccacattactctcacttgcttctacaccatgccctgcaggtgagtcattagccaatgctttgtgtcctaattaaaagtgtgactgattgtgctttttttattggctttgacaagctgcatgattaatagtaattgtctgtagtagaaacttttgtgtgacaatctcaatttcaaaactaataattaggctgactgagattttatttgaaaagtatatgagaaattaaggctaattaataggctttgttaagatattgattaagaaactaataaatagaaaaattttaaattaagattacactgttagagatcacaattgaatggactattacactttctaatgtttttttcttcttctttagggtttagttgaaatgaaaacatttattgtgtgtttttgtagttgtttgagttcggggacaaatataggggaaattatgatgctagtgtgggagtggtaaagagctactatgcgtcggtgagtggatacatggatgagttgttgtgggctgccacgtggctgtacaaggccaccgacaacaaaatgtatcttgagtacgttatttccaatgcgcatacctttggtggcactggttggtccatttcagaattcagctgggacgttaagtatgctggtcttcaactcatgctctctaaggttacctttagtgtgttttcattttatttaggtttcattgtttcaaactcctttttgattttttttcttctcccatgtgagtagctctttaatatctatcaactttatctagattttgcttttctaacatgaaaatgatggtgggttaaatcttagtactttattttaaaggtcattcatggagtatgcacgaattaaggtatattaatataccagtattattatctaggggtattaaagacataagaagtaaaaagtgtacccaagcacaaggccatgtgcagttagtgctttagctttgcaacacagcgcaattaaagtggtatatggcttatggttgagccgaatgttagagacgtgaagtaagagagccttaaacacctcagtacactctccctccctttttttccccttttaacaaatattagcaaataagttatgaggtagggcagcctttcgtcggctaacattttaagaaactaatttaggtcacgatgcattttgttaggaattaatcatatgttaaaaatggaagaaaaaaaagatagaatgttaaagtgtttcacatttataatattgaaaaattaaatgtttatatacttttaaggagtgtcagtaatgtttttttgctaatattttttcaacacatttttcttattggttgaaaatcatgtgagtttcattattttgagaatgagaccatggagaatgagactcatattttgtagtgagtcttacatatgtgtattgcattaaaatgtcacgtcagtgtttctgttaaaatattaatgttaagttaatagatgaacttttcatgaaaaaaaatagatgatctaaaactacatatcaaattcataaaaagaaaaaaagttgagggatggaatttgtgagtttagaaggatctaagttcattttaaaaaaatccgtaagttttttttttttggttagattaaacccaaagtttacataccatacttttgagttttgacgcaccttttttttggggttgttcatattaaaactgcccttcaaaatatttaatgtgtaacggaagtttttttatcttattttatttgggtaaaaaatgtgtgacggaagtcaggctgtgcaggtttctatgttacaagacttttggacaaacttaattagggttcatatttgtcgtaagtccttagcccaatatacatctttctctttatgcccacatgagttatttttttaattcatcaatggatgtatattcctagcatttatcaactcataatcatatcaaataagtctttattttattttaaattttatttggaatgtttacaactatagtttgaaaaagttttaaaattataaatatgcaaattaccttttttgtttttataatacgttcaaatatgtctttgattttttatatatatttgaattttacttttgatttcagataaatttttctttagcatttattttataatatttgaaaagttttattttagatatttatcttcagttaagtgataaatatttaataatatataaatttttagaaaccaaataattgtattgaatttttagaaaacttaatacatcaatgatatgtaccaggtgaagtatccaaaactgtatcagtatagaatatgtgaatcaaattgaattctggtctggatactacctatatccaagaatatcatatcggatatatattgaatacggatacgtgaaacaaattgaagtatcagtgcttcatatgcagcaagcatgtgcaatctaactattgtttcatctgtttttgcagttcttaagggaagaaaaacacaagaagcatagggatatacttgaacaatacaaatcgaaagcagagtactatatttgctcatgtctcaacaaaaataatgatagcaataacgtgaaacgaaccccagctggattaatctatgtccggcagtggaacaacatgcaatacgtttcaacagcagcatttctgctctcaatatactctgatttccttcaaaacacaaatcaaaagctaaattgccatggcggcacagtggaccatgaagaaattcttaattttgcaaagtcacaggttgactacattttggggtccaacccaatgaacatgagctatttagttgggtatggccctaactaccctaaaagggtgcaccatagaggggcatccattgtgtcatacaaaaagaataaagggttcatagggtgtactcaagggtatgataattggtatggtagccaggcacctaatcctaatgttctggttggagctttggttggagggcctgatgggaaagacaattttgaggatcgaaggaacaattttatgcagactgaggcatgcacatataatactgcaccattagttggtgtttttgcaaagttcttgcatatagaaaaccaaaaactggttcatgattgtaattcagttttggttgcctcctttaaataatacaatgaattaaaacagtatatgtttctcataggtcaaaagccaacttttcaatcacttttttctcctcattgatgagtgatttgtggtttggctgagatttttcggcctcaaatgtactcaatataaacaaatatatctatccattcagattgatgatatcagcttgatttgatgatttctctctttttttttggatgattacatcccattgaacaaataaatgttgccaattaggaagatggaccctaatccaaaagcaatattcagtgaggtaagtatgaaatgggtttggatgacacattttcatttgggctgttatttacattcctcctttttactttctgcattcctgccagtttgttttttcttttaaaacatatccttcataaaagctggtttccataatatagttaattttttattatgtgtttggttttttattttaataaataggcttaattttactttttttaccctcaattttttattttttttgtgaattttaccctaacaaattaaattgacatattttatccctaacttttaagaaaatttgcaaattttattacctatcatttgtccactaataaacacaaaagttggaagaaatttgtttcaaaaaataaaatatttagagataaaatttgccaaaaaataaaaaaattgggtgtaaaattcaccaaaaaaataaaatgaaaattggagacaaaaagtgaaattatattagaaataaattgacggaggatataatttgtaagtttcttaaaaatttggagtaaaatatgtcattaatttattgggataaaattcttaaaaaattgaaagtaaaaactataattaagtctaataattaaataatttgataaattgagaaatagggatgaaaacgttagaccaataaaaataagtcaacatactcatataattaaatatgtcagatacaaaatgatacaattgaaatgaaatacatccaaaaaatacaaagattatttttggattagtgcatatgttatttttggaagacttgtttttgaaaaagcagatgcttttgcttcaataatctttttctgtttaatgatgacaaagaaaactccatggaaatatgggggctcatagcaggatgagggaaaagggatctgcattaggagcaatagttggtaagacagtattgtaaaaccattggaagaatttattctgtctattgatattatacttggatggaatttgtcttgagaaagagcttcttctagtccttcatgatacctttccatttccttcataaagcttactcttcttcgccttcagcatcagaagatgctcttctcttcttgctagagggaggatgtgcatgcgcttcagctttatcttcttcttaaggtttttccaacctcattctctttatactttctttctcagagaaagtgtagtcctcacttacactcttacagagtcaccagtggagacaaatgtcgatgttaaaccactcttcaacatctttcttgcataatagacgccacccacacttctttatttcaggcttacgaggttttgttgcttacgaggtctatttatttataaaatataatagaaaataaaaaatacatattacactaataataatataatattattaattaaaaaaatttataagaccaatattaaattattatagtcagactagtggtctacaattgataattaatcactaagtctgtagcacactaatacgccttcgttcgcttcaccttctcggtttccagtgcaattttaattgatagctttttatttagttgttggttgcataatacaagatattatgaattgagcttcaactatcacttaaatgaggcaatttattattacgggtagtcctttaggctttgcttgagagatggattttagaggaaaagggaaaaaagggaaacgtgtttaagtaaagacatctttttatttgaaaattttaatttttgagagaaaggatttgagaaattttaaaacttctttgaaatcttccaaagcttataaattatagttctcccaatttgggagtttttagaaggaaaagtaattaaaattactatcctaccctaactacacattcaaaaatatattgaaatatatttttaatatatttttacatttaaattatataattttcacatttaatatcttattaattatccattccttcttttaatatatttttaactcccaaacaaggaaaaaaagaactttctttatttttctcctttttcttcctctcccttttccttaaatctctttctttctctttccctcctaactcccaaacaaagccttagagagtatgttaacgaaacttttattacttattagtctaagtttatgccttagtttttaaaataggttaagcctatttatgtaaaatctagcctgatttgacatgttctcttgtataattctgaccagttgtaatgtattaatgtggtattattttatttatttttgtgtgaaaaagggaaagaaacccagaagaaactatatttttggtttttttatcttggagaaacaaaatatccattttgtctcgctccatgcgttggcttgtttttcatttttcatttcatttgtgttttttgtattttctctattttttatcgcaattggactatgtggtccattttggattttttttctgtttgtttatttgttattttttgaaatgggctcaaacaattttattatggatgttgcttcttgcatttcggaaattccaatcgaaaagttctagccttttattgttgaagaagagagaaacaacaaatttggggctatgctagtccaaatcataataacaatacaaaaacaaataaaaatgaataaaaacagataaaagaaacacggatttaaaagtctataaaagggacccaaattttggtagagtatctttccttaaaaagcaattctaatgaagtaaaattgcatgatatataacacatgttggtaaaaaaaaaagataaagagttttctgtgtcatgcaggtggtgtctaacttcttcttttacttctttatgaaaggcattaatttagcttctgcttcaaacacctcactgcatctcttaactttgtggaaacgcatgaaatcttcagaggaccaatgtcggtgttattgccactgttgcaatattcttccctggttgttgctgataagcgccagtactcatcaacatcttgcttgcacaatgcacgccacccacacttttttatttcaagcttacgaggttttggtccttgatgagaatgttcaacaccactacgaggacgagtttcattagccagcaacaactgaagttggttcttttcacctttcacatattgccaacagttatcacgattaaagggtaagaacctaatgaatagttgagggcgatctacccaaccttgaacaccatatcccaatttcccatcatgctgtgaggccattcatcttcttcaggatctttttagaagaccataaaatgctacgttcccacaaattttccgacaccttaccttctaaaacatcacacatgtcacatggcaattcttgaccatgcagtggaacgccaagaattagggatgtttgttactattgatacagctgaatcgacaccatagtgatttctcgtgtcctcgtcaaaagaaatacttctgttttcaaaccacgatggaacttcactccccggaacctgtaatacgagatgcccctctgaacgctgtatgataaacaaacactattgttaactggaaaacaagtattaagtgaaatcagcctacaattaagttaaatccaaagtcataaatgtcacccaaataaaaaactatacaacaatctatggtgcagtatgtcccctcaaaaagtcaaggaatttacatggttaaaattccaccaaagtccaatatatatacttagaagaggtattatagaccaaagagatcaacttcagtgtatcttttgcgtaagtaacatagaatcaacaaaatattttgtttttctcttgtaatgtttcatacaaccatttggaaaaagagctacatgtgactagcagactaggtgcatacatcccattaccatggttaggtaaaacactatattggtcacatttaatttagggaaggcaaataggagggaggagataaagttctagaaattcatttgaatttgtattatatggtcaatgcgggtgcatagaaaccaaatatactttagttcttatcgatcaactgaacacagatgaagtggtgaaaaaatgataaaggtgaaaagtttgttatgaattaaagcaatgatatggaaaataaatctgtcgtggtggtctaacccattttatgctactacttgaacatacaaggatataataatgggaaacggtactccttgtactccaccatctaatatatttttgtcttataataaaataaaaatatatatcaccattttagtccctaaaaatatataacgcgatattaatttttaaaattaaaaaaattctaaataacaccagagagtgcaatccatcaatcacgttaattcacacacatatataacttaagagataatattaatatgtatttagggaccaaattaatagtaagcaatttagttggaataattaaaattttcaatgtcttatttatatagaattttcttaatttttaaatattaacaagatagtgtattacgtttttagaaatcaaaaccataccaagtttagtttaaaaataaataaatttgtgagtatgttttttcatcttctttgggcagttgctaaatataactctcttgttataaatgcacatccctttatgtaatttgtattttatttccctcaaagttacctcttgtttggaaactaagttgtggaaactgttaaaaattttaacacttatgctaaaatagcacccctatccttgctttaataaagtagttttcaaaaagtgtaataatactttcaaaaactatttttcagaagtaaaaatgggagttgtatggatctatcaagagagacacaaatgaagtctctaacattgttgtctttgagtttgtcctctccactttcacaaagcacgtcccctaatgtcaacctattccttacaatttaggagctgtgagagacagtggtgtttaggaagtcctactttgggtctctcttgacaaatttataaaactactcctaattttgctttcgatcgaaaagtaaattccagaaaatattataacatttttagaaagtagtttctgaaaattaattttaggaagtcttaaaatgttagccacttttcagaatttagttttcagaaagaaatcattttgaggaaagaaaaaacataaaggaagtacaattagcaaatatgagaagtgcattaagtgaatttccttggttttgatatttgatagcgaggagaatcatggttgacaagcattgccaaaattttgtgcctcttaaacgaatatgtataaaaattgataatatcaaagtacagtaaaagatgtttcatgttgaatagaaaatgcacgaacgaatgattgaataattatttaaacaaggtacatcgtattcaagattattattgatgtataaaccataaagaattaactatctattttactattttaaatataaattcacgtgccttttacgtacaaaatcattaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcacgtggcccttcctcttcctctaatccaagttatccatctgttcttgcccaacttatcacaaataaaatccaaatctatccaaaactccactcagtcacaacatataatacaagcaaacaaactagatgaacagttgcttctctcaatcaatattaaagcaaatgaacaaaagataccctcaattatggaggctatggccattaaagagagggtagacatatgcaattctgtctggtaactgttgaaaatgataacattggatttgtttcattgcataatgtccagatttctcgcctttgaggtatgcttttggaggacatgggataaatgggttccaggtttggtcagtggtcaactacagtcaacacaaattccaacatttatcaatcagtgcggctcataaagttgcttcactgtggacactggtgatggtagtaaaagctttgtcaaatgtgaatgaatgaattgccttattagacattgctatttgcttcatggattctggttttccaatggctagacatgagccatatattttattaagaagagacgaacataaaaaaaattatatcataaataaaagtactttaaaaataatacaaatttaatattaaaaaaaatgtaaactgcaaatcacatacagacaaattacaaatagagtgagttgatgaacaagttgacaaaatctagtgaatcttaataaaataattcataatttcaaatcaaattcaaagtaataatatggggataaaagataaagaagacacaatcagttttagcgtgaaaaacccaattagataaaaaataacgacctccaaattgaataatcgatccaatgaacaactccattatgataataaataagtatctttaaattctgatgaagagttaagaatcagacttgtcaaaagtttttatatgatctcataacaattctttcaatgatgcaaacataaactctctaaaactctaatattatttggaatggaatacatactatcaacacaaaaatatgcttctatttatactaatttaaatatatgattttaatcaatttttgaatgcaatccaaaaaatattttatcatattatgcaatgcaatcttaaagatattttatattatgcaatacaatcttaaaaatattctatcttattttttaatacaatattaaaaaatattctatcatatttttgaatgcaatcttaaaaaatattttatttattatacaatagaatcttaaagatttctattatattatgtaatgtaatctcaaaaatattttatcctattttttaatatattattaaaaaatattatatcctattatattatgtaatgtgaccttttttattatcaaattatttttttaatttttaatatatataataaaatttataacccaccctagttcccttatctccgcctctaggtagacctcaatattataaatactttactaacatccttttttttaattacattattatagtatctcatatttatatatttttaattttttttccttttctcttttgaggccaataatatcataacgtatgtgcattatctttctttttaaaaatatatctatgaaatttaattcaattagttgagtaaataatgtacataaattattatttaaaaaaatatttaaatccaattcttttacacatattagtcttaatttattatttaagtatattaataaatcataaatgaagaatattttaatttttatgtacattacaattttaaacaataaaatataacttaaaatatgattttaaaataattattttaaaaattaataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctagtttgtaaaattcctattgtacttcacattcaaatattttagtctctaaatttttaaaagttaataaaaatatttatttctcaaaattagggatcaaacctgacagtgaagtaaaaaactaaaacaaagaatcttacaaagaatagggattaaaaatatatttttttctttaaaaaaatcttaatttccaaactaatattatttttacagaaaaatattgacttttgacgatctcttgcagcaaaaaggaagctttttgtttaattaaaaaagggaagctttttgtcttaaaaaaattacgtatatttatttgcagatttgaaaaatgtttcattgaattctcttcactttttttttcttttatcgggaagtgtataaaaaaagagaaaagaaatgcattaataacaaccgaaagtttcattttgtgtctgccatttgtctcgcatcctaagaaagttccctttttatgatctctttgaaagaattggattcgaagttgtgatttttgcgcaaatgggtatcaatcaacgtcggtggcggcggcggtggtggaacgccgtcgttttgattggaatggtcggcgttacagtagtaaccgttaccggttccgacagtcaccagaagcagaaacaagtggtgtctcgaattgccttcggatcatgctccaaccagagcgctcctcaggttccaaaaaattttctattttgttatgctttttttttttttctattttaatttttctattttttattctagttctgctttgttttgtcttgtctttgttttatttatttttacccatgttgcagtgtcgtgtaatggaacttgtatgctaatgattctgtttctttgtttcaaccatgatgtcccaattcttgtactagcatgctgttgcggtgccaatgttacctcagctttaagcaaactgcagttctgttgtactcaacttaaaagaaaaccaacaacaatgatgctgtaaaaaaagtgtctggtataattttctgcaaacaaaataaatttgattaattttatggaacatgttccctgtttgtaagaattgttggtggggataattatgcatagtataatttttgttcaagagtgagatacgtgtgaaattccgctttatccccctgtttttagaagaaatcaaaattcattatggagtagtgtgtttcacacttttatcactaaaatcattcatgttttactgaaactagacaactttataatttacattgtacgttactgtatggtcttttgtagtatttcttaatcaagccatctaaattgtattgcatctacaactaaattcacgtaatcacagagctagaagagaggagttaagccttggtatctttttggttgtagtttgagtttgcaatcttacattggtttcttgtttgactgctttaggctacaaacctcttcccctgcacaagttcaataattgttattatttaggcttttgattgctatgcttgcaggatattcttaactttttcatgtcagctcatttatatatgtgcatgctgagtgttttgtttctttgccagcccatctgggatgcagtggttaacttccatccccaaatttttatatggctgggtgataacatttatggagacttcaaacgccctttcaaaatatttggaaaggaaaggactgttggaccgtggaagaatgttccacgatttgttccttcctctgagcaggaaatgaaggctaaatatgaaaaggcgaagtctaatcctggctatgctcgactccaacagaaggctgaggtgcttcgttctgagcttttctacttgtttttgctctctagtattcaaatttctgagtactaaaatggcgactatgcttatcaattcttttggcctgactttcacatttggtatgttaataggttattggtacatgggatgatcacgattatggattaaatgatgcagggaaagaatttcatggaaaaataaccaaccaaaagttgcttcttgatttcttggatgaacctcaagatagcccacggtgggtggataatctcttttgctgcattatcatgtcgggtgtatctgtattctacagcttgggtgatttgatttacattcttttaagaaatactagtatataattgaatcgttcgcttgattctgggggttgttttccaatattatgagacatatgattgtattggctggggaacctcattattttcttggagagtgaaggcatgtttacgtgtctggctaatatacgtattcacccattaataaattttaatggcaacagatacagatttagattttagatacttactctagcttctcatttcaggcggaaacaggctggtgtatatgcctcatatacgtatggtcctgtaggtagagatatcaaggtattgatcaaataaaatgtatcttctttgttaaattcataaagtcctttcacgattattgtgctgtcataggatgtaaccatgatcatcttaaaaggtattttgatgtttaagaactcattttgtttttgtcaataattaagacttgaaagttgcttttaaattgtgttttaacttttaagcacgcctcttgtgctaatatttacttttactgtggattggggaaaactgttcagattgtcctcttagataccagatatcacagagaccctgtaggaagtgatggaaccattttggggaattcacaatggttgtggttggagacagagctcaagggtccaccaacagctctcaccataattggatcttctattcaggtacagcaattaggtatcaattgttataatgccagagattaataagaattattcaaaatactaaacatgataaatattattacatgacatcttcatctttatgagttttgtctacattatcaattattatgcctgtattcttgaaactgtatatctatatttgactgggtgcttttctcatgaaaatcttgctgaactcaatatataattcagttttgtgcttgaattgttgcaccttggaaaattgagattcatttttatgttaatatgaaatcatttctatattcttttctatgtcaggttatatcaaatctttcagcaaccattcatccattgttctcaatggaatcatggggtcgttttccaaaggaaagagatcgcctttttaaattaatcgctgatagtaaggtaacaactttcagtacattcattttctatgttttacatctatgttgttaaagggaattacgttggtatcatttacgtagctgtagtgaggtctcatttcacttgttattagtcttttctatgcagagggctggagtattttttattagtggagatgttcactttggggaaatcacgagatatgattgtgctttggactatccactatatgatttaacctcaagtggggttactcaatcagttgaggaggttgtcccatctttcttgcgttcttttgtgagatttgtggcatggttgacaccatctacaatgagagttaaggaccaaaactgcagatacaaatcttgtatttatggtaaacttttcttccttttttttgggtaagaatatttactgtatattggctttcatgttttgatgtttcaattgtggactttcattaggtcagccaaactttggaactattgaaatagattgggactctcacccagtgactttgaaattcaaagtcagggacaaggatagtgtcacagttacaggcgttgatgtttcattaacggaattacaaccatcaaattcagagattttagacagggtaaaagcagagcataataattcaaagcattgcactcttgaagttagtctaccatggattgtaagatatcgcctggcaatcttgttctttttcaccttatttggtaagtcacttctaagttccacttgctagtgatcctctgtgtgtgttcgcacatgcgtgtcatttactttggatatcactcttttaaagtttccatgcatagtatgattaaaactgaattgtttgtgtttttggtattttgcttactatcatttggtttcaagggatatttttcatttttttttttgttgcagtgatgtttgtttcattcctagtgctagtttacacttgcttcagactttgccgacttgaaagatgcaaaagaaagcacgattgacaatcgtagatatgtacacagtcagcaaaagggagcatgtgttattatctcttctcctttgtagatttaacatcagtggttataggtcaataaaatgtatagattattcttgtactgtttccactaatcaatcctttatcaataggcacacttagaagttggtttttttgtgagtgaattggtggttgagccatttagatatgatgcatagaatgccatgatggaatccggtagcacttgttagtatttcataagtttgtgttcagttgtttaaaacatggatttgcaaatttggtgtgcacttgtatcaagagatagaaaacaaaaagaaaattataaatgaattgaggtaccttcttggaaaagacatgtaatttgtagcgctgcttcacactcagtttattacaccttttcctacacactctatggtaagaaagagaaatatgtattggtaatgaaaagaaaaaagaagaaaaattaattgtttaacttgctatatagtttttgaaattttaacgtctcaggaaaaaaaaaattattccatggattattctgtataataatataaaaaaatctatggccaaagttactatatgtactttctgttttagccgtgataaccaaaaactcctgataggaagtcaacctaaagtcaacaaagtctatcatatattcatacgcaacttcctctctttttcctcaggcttcattatcagttgcaccaacaatgtgttttgacgtcaaaagaaagagggtcttttccatttgagatattcttgttgtggtcaatgaataattggcacaccattattaaaaatttaaaatataaaataattgcgattcaacaattaaaatatataatgtaattttttcttagcgtttagcttctgtcctttcattgaagtcaatgtatcttctactgtccaaaacaacgatgcgttagaataatttgtaaaaagaagagaacactagaagaatagagtatacaccagtccagaacatacaactgttatgggttggtacacaattctttcttataataacaatctgtactttatatttttataacaccttttttttttttatttttcttattacattactatacaactgttatgggttggtacacaatactttcttataataacaatctgtagtttatattttataacaccttttttttctttttcttattacattactaattttattctacattttttatttgatcttttttattgtaaaaattatcataagtaagaacaacattatccatttttctgcgtctgctacttgcatttttccaagttaaaaactagtagcatgatttagacggcaactcgtgtgggatatcccctcaagcaagggaatcgtacatttgtcctcttattttctctaaagtcaaactacaatttatcttcttcccattccatgtcatacaattctacatcgtagcagtaacgggtgggaaaccaaaaacaagttcatacttattactttatccgcttaaacgtgtccaaggctttaaatatcaatcacaaaaagatgaatttgttgatattgcagataaatgcgatagacacatttctaactaacagtcaacacttaaaaagtcttaatgtttgttggagaaaaaaacgctgtacacacatacaaatatgaataagaggataaatttaatgaaaatttgtatatttcactcttgcatttacacatatattaacctgttatatagttacaacaaaaataacaaaaactaactatcatctaacaatctaactaattgttaactacatcttacttatagttggattaaaactcaacactcccccttaatccaaatcattacaagatacaactctcaaatcccttctaaattttacaaatctatcagtctaattgtcttagttaatatgtcagtcaactgagtttctgttgagcagtgtgtcagtcagttgagtttctgttgaacagtatgtcacttaaagcttttcattattcacctgctcccttaggaaatggaatatggtttcaatgtgcttacttatcccatgccagactgaatttttagctaaattgatggctgatttgttatcaattagcaatttaataggtttctctacttcaaagttcaatttatctagcaatgaatctagtcaaatagcttggcaagcagcatgtgagtctgctatatattagtctcacaagaagacaaggccaccacagattgtttcttagagcaccaagaaattggagcacctaaaatcttaaacaaatatcctatagtacttctcctatctgttttatccacacaccaatctgaatcaaaatattccagcaccctaggaagatattttaattgttgaggaataagtataaactttatggtaatcatagttaaatccaaagtgttttttaaatggtcagattgatttataacaacattgtggttaaaatgattctatatttcgttattctccttctgtgtcagaagcaataatgaagttttagcataactactgaagttatgatgtgaaagaggactaagctagaaaaacaaattaccagtggatagaatgagtatgatgttaagttctgatttaaacattgtgctggctgctaaagaacccaggaacatattacatacaagttttatagaggctagtgaactggatagaataggaatacttcctccaatatataaataaaaattacactaaaacttgggcactgatgttagcatttagcaggaagtttattgaaatagtatatcagaaaaatagaatagcacatattctatacgaaaatagaggggtggaaaaagaaattggaaatgaattttcataccaacattaattgtcatgtggatttcatgaaattaagagcaactgccaaagtataaacactctaatatccaaaaccccatatctccgtctgccacatgtaaataactaagtatagatcagctactttatcataatcatttcatttcatttgcattttcccccaactttctagatatgtttcattaaattttgtactctgcagtctctttgaatatcataaacagaatgcccctaatacagctaaagtccagtattggcatcaagaattgcgacagtaaccattttgaaccaaagactgatggcaaagacggagtccactaatggtaattgataaaccatttttgtagtgatatttctgtgtcatttgctgcattttcttgcaaaactcacgtttattttgtcttgcagaagcatagtcgctgtgaagagagtggaaatttctaattttacctaaagatttaaaaactttgtcacatgacaacggcctaatacatccaacatgaccatagtgagcatgacggtcatgataatatgatgacaactatctctgaacagtgtcaatcttccgacaatggccatggtgaatttacatgaccattgataaatgagatgaagtttagttcattaaataaagatgaaaacatttatatttttagtaaagaaatcttcaaaaatatttataacttgtatttaaataaaagtatatccgttgtcatcttcaaatttaattaaagtagaacttttacttgttacgaaatgctctaagacttggtacaaggaaggcataaatataatttcacattaggacaaaaattctatcaatactttatgggtacttaaaaaaatactcaggataatgggtacacctgcattattaatcaactttaggaattaaaatattatatttaagaataattatgttaaatgattatattactcatgtcgtatgattagatttatatgatttaaagaatgatttttcaatttaagaacctttttattagaatatttttaaaaaaattataagtatattttttaggacatcttttaattgattgaccaactcaaattatatatatatatatatatatatatatatatatatataatataagaattttagaaaaataattagtctattcgagatcttagaagagatgagatcatatgaaaaatctaacttattctttcctctatttggactattggccatatggaattttacatttttagaggatcgatgtttagttttacattgaaaatttgattttaggtttagaattaattgtgttaaaataattttaaaaaagttaattttttgttgaacaaataagtatctatttggacacatgttccaacataaaaaatcacgtccagatgtttaaatacgtaaaagctacaatggactgcttcataagtgataaaaaaaatcacataaaataagtgaatgcaaatatattatttatagaaataaattatgataaaaacattccaacacaaattacagtaattcaaaatcaattaacacatgcgcgtgcatgcgaagtgtcctttagttacttatgtgttattctataaatttgacatggcattcccatatcattcaagttcagtcgatttataatacacgttttggccggtaataactatatataacaaaagttaagacttaagacaagaacattattctttttttaattcaacaggggtcatgtgtgacagtgtgtacgtacgtgttgctcgattcatacctctcaaaacagtgttgatgaaaatgaaaagacaggttcttatcatcattgtctgatataggagtgcgtctgaattgaagttttgttgtgtcacgaaattaactggccgtttcttgaacaatatattgaaagtgacaaatgtaagaaacattcaaaggggtcgaatatatacacctttagtaggtgtgttcgttcatgcaatgcaacagcttagatttttaatattcatccacacactgtgatgacaagtagcaggagctaattgttacacgcaccccatgagattcgctgatgcatcaagtacctttccagacaaatttattctctctgccaaagttggaggaagtttgagtttaaattttgagaaaataaaagtaaatattatatacaccaattgatttttgaatagttatttgaaatttatttactaacatgtcatcaaacacacattaaaaaaattgaaatattaaaaatcttagagatttcttttatataaaagataatagatgatagataagagagcaaagaatggtcattttttaaagaacaatacgtagtcaaataattattttctcttctagttagtttgaattcaattaaagtcaataataacaataataataataatgataaggtcaataatagtcattagaataaggaagtggataataaataaaaataataataagtagagttttgttttaaaaataatgcaaatttaaggtgagagtatgttgcctcgaactagggtcaaggtaggctcccaaattttgttacatcacttgtctgatgcttacaagtgatagtcactaatatgtttgcatttgattcatttggatctatatcatgtattaatcacggatggataccaaaggtgggggctaacttactttggtacgcaaagtactctttcaaaatttatttttaaaaaaataaaaagttttcattttataaaataaagctaatagtttaagcgaattctccgccaaaagaaacagcagaggaaaatatttagggttgtgagtgtccattgaatgttagcaacacatctttagatatattcttagaacactttttttttacaattagtttaaatttattaaaatctgcaaaatttaaaagtctcaatttttttatttatgaatacgcttataattttatagtttttaataatttatttaatataaataattgtattttaaaaattattattaacacctcttaatatattaaaagatagataatcagtcgagagaataataatagatttagggtctgtttggtaagcttctttagaaatactttttaaagaagaagaaaaatgagatgagtttttctataagtaaaaataagttcttcattagctaatttttaaaaacttaccaatataatttctctaaaagatgagatgacatttacaaatgaactcatagaaaattcattttaacttatgaagactcatttatttttttctttttactttcttcttctagaagtacctttagagaagcttacatccaaacatacatttatcctgcaacttcttaattggttacgcttaatcttggattatgctatgaacatatttttgttttttgttttcttttaaaaataatcatattatcgaacattaaatattaacatatttttcaattttgactaagaatttttattcacaagtatattataagggactaacattccacgaagctcaaccatgttgatttcctttgttttatataaattactcctatattatttatttcacattcttttcaagaaaaaaatgaatttcacattctttgattaattgaatttcagtctgtaattactttactataaacaattagtggtaagttaattggtagtagctcactaggctagcctaggctagcatggagggtttaaataatttacacagcgttttttttaacagaatacaaagtcttaatttctttttttttttttttttnnnnnnnnnnnnnnnnnnnnnnnnctacataatttcacaaaaagataaaagaaaaaatcgggactttaattttctcttatgaaaatataatataaaaaaatcagaattataaacaagtgtgttttttctctcttgcgctaaacataatgtatgaattttgaaaacagaaaaagaacaaagcatcaacatcgctacactcagaatataactttgctcaaagtcaaactattcagttcaacaagtgatggaagtgttctttgatgcagttttatggtggattcaaaccatatgttgtaattaaagattttaaaaaatgaattttaagttagacaacagaataatgagtgcatgtatgtttggatgaagatattaaaaagtaactttactttcaaatcatcaatttgctccttcttcattttgaacattaaaattcataaatattttttgtaatttacaaagaaaattttccaatatttttctaagcatagcctaataattagaaaagtttttcaattatttttaatcataacaaatgctaatcattatgacgaaggctgatcaatactccttagttagatcattgattaaagaaataaagaaaaaacctatgattttaaaatgttctcttatatatttccaattaaacatttttttctagtaattcgttaaccagtgctctaagttagcaagatcctatacttatgagtattttcaaaatattcatcctttactctctttgaatttttttttttttgaatttttacttctagtctctgttctttcttttgattttttttgggtctatatatcttattttatttttgttagacttgaactttaatgaagaatttgattttaatttccacattgttctagaagcatgcattttctattgtcttcgaaaattgccaatagacaacagtacaatcactcacatagtcacatggacataatctcgtattatctacgcattgtattatcaacagtataaacactcacattgctctagaacctttcctttaacacatagtacagaagaggatgtggtggtgttgtaattgcatgttgataaggatcattttctcctttaacatacattgagcatgttacttttagaaaatgtttaacgcaacaaatgatgcatacaaatgcacttctccaaaagcttcaatttctggcttcctgtgtaacagatagaccaacaaagcttttcaaatttcaactaaaactactcagttaaaatttgctgatgcaacaaacaaacgtacctgtataatccaccttcatcgtccaattaattgtttgttcatcatggtaattacttgataaagcaagaggagcagaagaacatggatttgtaaaaggttttctttttccggatgttcactacgactgtgactttgtgatggcaaattaggagtgcctatactgttccatcactttcccaagatgttgttttcattaggccagtacggtcttcttaagccacacaacaatagcttataaaactccaaagcacgcggacacaaactttgcagttcagcatttcaggccactcatcttctcatcaagtggacctattacaaactagttcttttcaaacttgtctttgtcatgacatagctaattaactttgcatttgcacactaccttctatatgttgcaactcttggagctgaaacactcacgcacttcagcaaaactctcctcagttatccctccaacagaagataaaacatggtgttaacttcattttcaagaaccctttttgattgttcaaagcttatttctatactttgttgatgtcttaatgatttttgcatttttgctatcttctaggttctagttgcaagtcatggcgaggaggaaaaaggggtagaaggcattgctactgttgattttcgaggtcaccctgtagacaagacaaaaactggaggatggctagcagcagggctcatcttaggttcatattcatctcaatccatagaaattttagtcatgttttcaaggttgaaccaaagcgctcttcaatttggctccaacacatactttttctttttttttatgtaggtactgaactggcagaaagaatatgtgtgatgggcataagcatgaacttagtgacctacttggttggagttttgaatctcccttcagctgattctgccaccatagttaccaatgtcatgggaactctcaacctgcttggccttcttggtggcttcatagctgatgctaaacttggcagatacttaactgttgccatatctgcaatcatagctgctttggtatgttaaaagctttgcatatttagatatactcaatgctcaattctctaatttcttttggcttttaatcacactaaagcaaccaatttctcccttccctctagggaaagtggttttcaattgcaaataacataattttcttagtttaatttctatgcacctaactatcaatcaatcagaaacaaaaatcatcattagtatgacttatgacttgtaaggtaaatattataaaggtcaataaatttattgtaggttagtttgtaattggataacatgtaactaagtaaatacactatttactctaacatattactagctatactatcagtcacaaactagttttcttatcacatctttcttggaccagggggtgtgtttgttaactgtggctacaaccattcctagcatgaggcctcctgtatgcagcagtgtcagaaaacaacaccatgaatgcattcaggctagtggcaaacaaatggctttgctatttgtggcactttacacagtagcattgggtggtggaggaataaaatccaatgtctcaggttttggatcagatcagtttgatacaacagaccccaaggaggaaagaaggatggtgtttttcttcaacaggttctacttcttcatcagcatagggtccttgttctctgtggtggtgctggtgtacgtgcaagacaacatagggagaggatggggttatggaatttcagcagggacaatggtgattgctgttgctgttttgctttgtggcacaccattctatagattcaagaggccacaaggaagccccttaacagttatatggagagtgctgtttttggcttggaagaagaggagtcttcctaatccttcacaaccctcctttctcaatggttatcttgaagctaaggtcccacatactcagaggttcaggtaaattttctgtctaagcaatgaacatgactaagagtaaactacttacaatattagttcttgaaattaaaaaattctaaactttttttaatagtaattcgttaatcatattagtctaaatttaagatggacatattactgataaaaaaagctattaacatatgtttttgtattgggattgaccacagtccgtatggtcaaattgtaatgataaataccatgtgaaatatgtttaaagattaaaatataattccttaattttaagaactactaatatgacaattttatacttccatgtaccaaaatggcaatttactcttaatattatgtcggattgtctttttcttcaattattgcacagcaatttcaaaagattttctcattttttgtggttctgataattattactttcacgggattattactatttctattactatctgggacaacataagtgtttgattgtctcttgaaaaggacaaattttacgtttgattgaacagtccgtcaaaaaggaattttgaaaacgaaaaaagagcagcgtctgttggaaaggaatagtattttgccccttttttttcaaaaattattttgtaaagtgatttatgaaaactattttttaaaaaacaaaaacaaaaccaaaaaaaaaagttttttttagagtatatggttctgccaatgaacacatatttcctcttgacacatctctgtcacctgcgagaaatagaaatgagacatagatctttctcactcactcacttaaatcacaatggagacgacacatctattttttttcagctacacactattctgtactccactcagatcacatttagttttgaatgtaattaattctgaagttaagtaatttgattttatttaaatgtttttattaaaaataagttattaatagtaaaacaacgaaaactgttctaatatagaagctatctaaaattattttagttaaaaaatagtttttagaccataaattcatttttcaacttgagattaaatataaatatttatccaaaaacaactatgagatattaatgttctttaatgatccaacatagcatttagctttgggtgtttaggccttccacttccacaggcgacgagaatgaagcatgggtaaagagaatcggagaatgcaattgaaattacaaaaagaaaactttagaaaataaaatataataataacatttaattgaacatttaaatattaaaactgacatagaatatattatatatatatatatatatatatatatacacacacacataaattatgaagctgttaaaaaaaattccgtaagtatttttagttaatctttgtacatatcttctaatattttattttcgatataataaataatagtgataaggtttaaacataaaattttatatagattacctaaattttttacgagtaggccgatcctattagatcgattatctaatgtgtattctactctttaaaagaaaaaaatcctttactccaccactataacatttttttttttttgtggcacactcctacgaaacttccagtaaagaaattacagtgatttgtaactaccgatggcaaataaggcactcattttgcatgacgaattatataatagatccaaatatcttgcattagattgaattatctaactgcaaccttaaaacaagttttggattatatgattttaatttgataccatatttattcttgaatcaacatatgtcaatagctatgaattgattcttcggtgaaaatacaaggaacgatttataataaaaatgtcattcatttccttgggaaatagtaagctaacatgtattttcactgctttgtatttggtctgacaggttccttgacaaagctgcaatcctagatgagaactgctcaaaggatgaaaacaaggaaaacccgtggatagtttccacagtgactcaggttgaggaggttaaaatggtaatcaagctccttcctatttggtctacatgtatcctcttctggacaatctattctcaaatgaataccttcaccattgagcaagctacattcatgaatcgaaaagttggatctctagttgtcccagcaggatctctatcagcttttctcatcattaccattctcctctttacttctctaaatgagaaactcaccgtgcccttagctcggaaactcacccacaatgcccaagggctcacaagtctccagagggttggaattggactcgttttctccattgttgccatggcggttgctgcaattgttgagaaagaaaggagggtgaatgcagtaaaaaataataccataagcgccttttggctggtccctcaattttttctggtgggtgctggagaagcatttgcctatgttggacaactagaatttttcattagggaggcaccagagagaatgaaatctatgagcactggacttttcctatctacactttcaatgggttattttgtcagtagcttattggtggcaattgtggacaaagcaagtaataaacgatggctaaggagcaatctgaacaagggcaggttagattacttctattggttgctcgcagtgctaggagtactaaatttcatattttttcttgtattagcaatgaggcatcagtacaaagttcagaacagtataaagcctaatgacgatgcagacaaagagcttgtcagtgcaaataatgtgaaagttggagttgatggaaaagaagaagcataagatatagtcttaaaatctcattttgtgtggcccaatatatagtgtgcaagaacaaaacattgtgccccgaatttgttaatttttgggtattttgtcgacctcatttaacgaggacaattgtgatgtataattaagtatttacagagataaaaaaaaggcaaacgacagtgtgagttgtttccaaaagagaaaaggcaattatggaataaattataaatattcccaaactaaaaagatataaataaatgaacacttgctagccaggtttcatgagcagaggcctgaatttgactaatgttatcagtagaaaacactacagaatcatagaatcaaactatgacatgatcttgaaagcaaaatttagtccatttgagaccaaagctttaaacaatggcattggatagttttagtatcaagaagataaaatctttaagaacgcagaagactttataaagcatcggtaaccgagggagatctgtgacttatgaccaacggaggccgtagagctctgtgcgcttcttccttctgcttgcgtgccttgtacatttcctcagtctcaataacaactaacctcttgacctatattaaatacaaagtttatcaatgttagtatacagagggataagtcatatcaagcagaaaatggacttgtgtagatcttttgctaaaacctgttggagcattcccctaactgtaggtgtgttccatcgcatgacagttcgattgcatttgcgcaagcgaagtgcttccaaagtgcgcctatggagcctcctggtccccggaatacccctcaccagagttatatagatattggggctccaagcaattggcacacaggccttgtatgccttgaacgcattcatgccttcagcttgaagtcagaacagcattaagaaacaaatcaagttaatatgtttttcctactcaaactagataccaaaattaaacaattatcatacaaaaatagataaaaaaaacaagtttaaataaaatcagtcttgataagaaaagaaacaaaatccatacacttcattcaactccaatactgcatgtttgatactacttgatgcaagcagacagaaaatcttaccttgaataactcacattgaagaaaacagttagagagtgacaaaagtatatgcaaataaagtagtgaaggaaaggtaagatagcatttataaaacctccttgccattgaaacaagaaaagattaaaaaagatgataataaaagagtgagtaaattacacagacaatctcctaaaatttcttgagattacacataacataaccatcttcttttatttttatttttatttttaacgtttaaagcaaccaccttaaaggggtacacggtgtaatgttttcaaacaataaagggcgttaatataatgtagaagaggtatcatcgtaatgttcttccaacagttaagagggtttagcgtaggggtaaaaaaaagaagggcgtcgggagaaaattgacgaaacctcagggggtgtaagtgcaatttactctaaaagatatgtacaatgacattagctcgggcattttatcaaacaggtggtaggcagatacgcaagttagataaatcacaagagccgttacaacccggccaacacaagttatcaactacgattcaacgtgatatagggagactcaattatggatacaaactagaacatgattgcaaattggaacaaacaaagggaatgaactactgaaaaaacaaacaaactaaataaatgtgaagttgtgaatagcttcaagttaagaatcaaaaagagagaaaggattaccgttacgcgtgcggtgcgtgagcgaagaagaacaatcacccgaaaaggttatcggctggaaggaaatgcggacaccactgacggaagtgtttgggttaaaaaatgagaaacccctaacgccccaatcaacaaaaagcacagtttagacttttgtgctaggagttttggtttggtgatccgggccgggtcgggtcgggtcggattgtttgaaactattcaacagatttcgaaggggaaaaagagtcacacattggtgaggtaaaaagttctcttaattgtaaattgtgttatttaatttttattattctgtaaattttaacaaagcaaattttatttttacagattttatcattcaaaattttaatttggtaacattttattatagttgatggaagattgtttattttaaattttgatatcaattataattttaactcatgtaaaaagtaattttctatattggatatgatcataatataattactttttgacatcgatcacaactacatatatacaaaattctagaaaaaaataattttttatattgttttgttatcaatttaatggaaaaatatataaaaataataaaatttacaaaatgttaaaagttgaatgataaaattcgtaaaggtaaaattcgataaattataaaagttagatgataaaatttataaaaataaaacttgactaataaaattcatgtaataataaaaatttgatggtaaattttgtaaatgcatttaaaaagttgtacatagttatttaattataacttattatacattataaatttgttaatttttatgataattagtttaaaagttatattaaaagtaaattatgaaagtaccaaagtgtaaacaatgcacatcatgttgataaaaaataattttttttttaaaaaaaatgttttgcaataatttannnnnnnnnnnnnnnnnnnnnnnnnnnnnnnnnnnnnnnnntatgatatattttcaacaatttgtttgccttcaaacacgttattcttaaattatttcaaactttctaacattttttcctttcagctttatacatatctttttttgtaatatattatgtaaaaaatattttttttgttaaatctaaataaaattaattatttttaaaaaaattcagtaaacttattcaaacaaaaactagtcctgattataattaattataacaataattagttatatatacgataaattgtttaaaaaaatctaattattttttctattgtcccaaacgcaccaatcaaacacatttttttttctttcatttcagctctagtaaataatggttgtctgatggttatttgtagggagattgtgacacactttttaatgtcaataaaattcgtgactaaaattaatttaaatatacaaatcaatcacctttagcttaatgtaatttttttcgacctgcaatttttggattatgaataaattttgagttttgaatgaattaaaaacaaaattaattgatgagttataagttaaagaggtgagaagttaacaaagaaaaacatcacccctttttatctttgcatgctttcacgtaaatctttttttgacagctttcacgtaaatcatatagagacctgatttttcactttgctaactctgtctggaataattagtttttaaatgaatgatcatggtaaaattagaactgttgagtaatatattatctaatgtgtgttttttgtgttctattcttgcgagagagagaaattcaacgttaatcaattattcattattacatatgttatcatattaattcttacaaaaatcatctttaagattaatatagagaaattttgtctttaataaatttattttatgatcatttaaaaaaaggaactaatgtagaactaacttgaagattatatataatattactaggaaatttatgaaaatgctggcttgatgtacaatttattgtagaatttagtattttataaatttggataggaagcttctcaattaagtattgaagttttttctcatttaaagaagcatttgtattacagttataatattatatttttaatctaaagaaaaattgattttttttcaaagttattaattttttttataattttaacaaattttttaattgaataattttaacaatttaattctcaaaattttattataatatttattttatatgttcacaataagtataagtaaatatcacccgtatcaggcatggggtaacacactggtacttatatacaacatttacacaacaatgttttcaatagatatacaaatttacaggttactacatgttgcataacgaaattataaaatgctattagtcttcatagaaaggcttaaccccattaggaccaattgtatgttacctcggtatagcatgtaaaacaaataactagtatcaagccctactatcaataacatataaagaaagatagtatattgaatgtttctataggtttttttgttttatgcacatactaaatatactttatgaaaagaaaaaatcttacattttcttaaagtctaattaaaccatcaaaatattacaaaatcatttgtatgtagatccaaagtcatgcatgaaaagtgctacaaataaacaaagttcccacaccctatatatagtattaattaatccaaaaataataataacatacatgaacgatgtgagtgaccaaatgaaggcataagtatatttactattaaaagcttaaacaaaataaaatgagtttcctaaaagattgcaaaagtattatattttctaaagtaacataattatttctaaaataaatataaatataactcctatacattttgtgtttttttgacgaacagagaaactttctaaaagcaccatatatacttgatctaatttaatattgaagcaataatttgatgtgttattataaatttaaataatgaaactgtttgctccattgtccaactatgatgaagaattgtttctctcctattcggaggcgacctcctgaatttgggaaatatttgtaggattagaactaataatttgattttctgacggtgaaactaattaaaatgtattattatccaacataatctataatttataaacatatgaatgagatgatatgtaacacaaaatttttgttctattttatatcaaattaccatgattaattgtacaattctcatttacttttttctcactaccactaatgagacattgatatataatacataaatgatccataaaataacatttagttaattaactaattttgattactgcattaattaactaattttggagattttataaattcaaagttttaaatacttatgcttgtgtacttttatttatttatttaataatcgaatattatatgaatacccgctgattgtttttaaatgtacacatttgttcctttaaaataataaactatttttgcacacccccgacttaaaaaggggcttaaaaaaaggaaaaaaaattcttatagtgatgtaaaatctacctttcgatctctgtccctctttccacatatcgatctatacacatatacaccattttatacaaaccagttttatatctaataatgataatctttctcagtcataatcatatattcgttgtttttgtttacacacaaataaaagaaacattagttgctgctccaaatgatggaaaaccttggtcacaagaagcaaacaacaagggctcagtcatgatgaccgcataccaacactgtacgaccacaacatttctaacacaaattaacaaactctattgcacacatatagtagacatgcaacacacgtgaatcaagaaatttttggacaacgataattataattatatacaagtagtcaagtacaactaatgtgttcaacagcgttgtttaacccaagtgatgtgagataatatgagtatatataagactatgttgttaaaaaaaaaaaaaatggtccttcgattgatgaatcaataccatttagatttttttccagtacattaaattttttttatcagtttaatgcatttaggtatgaaaacaaatcattttcattaaattaggaaacaaaacatacacaacatctctagtgatctccacaaacagtgtagatgatagagcatatagttagattcacgctaacttacatagattgcagttcagagataacagagaattttcatcctgctttctacaatttaaagtaaaacattcatcaatgacattaaatatagcaacctggcgacctaggaaacttaaaatagatagggttttctcggctaagcttttgaatattctagtagaggattgagttaaagaagcataggcatgccatccattggaaacggcttgcacataacattttccatgtagtagttagttgcatccatcacggcaaattgcatatcctcagaaggcttccaatggcgttttctctgattgatgaaccagttgttgatttgtttcagatctaggcctgtggattctgcaagtgcctgcttttgagattcctacgtgtttatccaatcacattcaccgttgccataacattagtcatcggatatatatatatatatatatatatatatatatatatatatatatatatatatatatatatagtaaacaaaactttatgaattaattaatgcacaattgactgttgataccaacatactaacaatttaacgtttcaatattgaaattcatattaccaggattattttctaattaataccaaaggctatagcaccatcaaatgtggctatattttggtgaaaatataaaggaaacaaggtattttgaaatgaaaatatgaatatttatcaatatacacattgtgaagggatggtataaactataaagagaagtacagctaccacactctataatacgcacacgctactcttgattaaaatatgttaaaaatacaaaatcatacatgagactcattaaacatgaagtgtgacccataaattatgatttttaatcattttcagccaaataatcaataaagagtttgttaaaaaaaaagtgttactagcatttctctatggtttataaaggatgtagaacttagttaccgaagggtaaggccatttataatgcctgttccaccaatcaagtagctgttgccgagcttcctttggcaactttccattctttttcttcttcaaaaattccttcttgaggctccctagatatccactatacttgcgcaaaagctggactttaagttcgcggtcttcagcttgagaatctaggttgttttcatgaacatcaacctcattctgtgaagatgtttcactttgaccttaaaattgccacaacaaaatggaataaaaattaatagttcagtaaaaacaattcatgcaaatgaatatccatcatgaaaatatttgacatcataaaattgcatgtcagttataactattgacaatcaacacagaaataatacataaataattctaaatcatactaatccccgtactagataaagaaagtatttttatttttatttttattttataagacattaactatatttagttattcatttaatacaattttcataaagtattaagaggattagtagaataatatgataggaagatataacattattttattttgatatgtatcaattaaagaaagcattatgttaagattatatgttcatttttctgaattatcaaataacatgcattgcctaagaaatgacaaaaacatgttaaaaactaaatttcattgcaatgttttttctggattacacactagctttgttactaaataggagaaagttgcaaagaaaataactgaactttagatcagtgcaaaatgtatctcaccatgcatacagataacttcttattataaaaggccatttaagagtacaacctttactaaaaaaaagtaagctattataaacaagagatatggttcactgttagagctaaaaatgtaaccctttcctccaccaccagagaacatactaaggaaggaagtaacaaaataatcatgcaaactcaaaatttacattggtttttcttttttttaatttaagctacagaggaaacaaattgacaaggaaacatatggcaacataagataagacaaggagtttcctttttcaactaagttcttaaagggactttgacagagagagccatgcatctaaatgaagagaatgaattaaacagaaagaaggaagactaatgccttgcaaaaggtgctcaatgagtacgtatgaaataatgagtaacaccaaggtcacacgaaccaaaaagaaaaatacctttaaaaaataacccgaaggccatcaagattatcaatgggtcacttgattaagcagcatatattattggggtacgcataaactttttatcattagaataataaaacaaaatctcatttttcttgatttcccctcaagcagtaatatggattaatcatcgttttcaaactttttgacctaattcaaacaccttggacccattattattaacattcttaaaaacactgtaaaggtttttaatcaagttcctttataactaatcacactatttacgatgagaaaggtaatttgactaactctttccaattaattcagatgatgatatataataacaaacaaattcagtatcacatcattcttagtaaaaacacatttatccagcacaggcaggtgtggttttcgtttttttattggtatcaattgcaccatcagctgtgtggttatcattaattactctaccacttaatattaatatttaataccaacatttagcattgaaagacaatattgcttctgaagatcagagttatgagtagtaactagctagcaaggtcatagatcccttcaatgcttgcagcatatttccagagggttaaaagactttgagacacagaagaactaccactagcctaatggtatagcaagttaagccgtgattcatcattacttacttagcctctaaccaaaacctttccacacagggttaatttctagtaataatttcatagtggtaaaacaaggatccatgattgtgttgctaattcattcatctttcttttctctcctatataatatataggtcacacgagcatggattactaattaagttgactctcacatatactgacacccaatctttgtcacccacttcccagaacaagaaatcgtagtccataattgctccacagtactcagagaagtgtaggaacaaataatgatttaagggtaattaatcaccaaaatctgatgaaactgctagggctttgagctgacactcaattcttgagaagaaaagcatggcttctttgaagggttttgtgagctcttgctcatacttaatgagcatctcacagtaggcctccatgaactggtccagagctggatcttcacctattgaaccacctcctgtccttcctgatgatgcattgaaggactcgcatttggcacatgactcctctaagctagccaccacttctggaggtgctccaacctgtaaatactccactcacaccatcaaaacaagaaaaacatgaaaacacataaacaaaaatctcaaagcaaaaccacaacagaaaatttgagtcctcatgaaacccatgaaagagaagtagagatatgagtgcaattgtagttgtcaagttaattacaagagtgtatgatcatacagataaggaatattttttttttttttaccgaaaatattttttagttaatattgttagtttttgtctgcgagatttcaaacccacaacttctttttccttttcttcttcctttaccactaaaccaaccttatacattctatataaggacaatttgtgttaggaggaaagggaaagagatgagtgtaatttatgtgaatatggagaacaatatagagtttatcatcaccttgaggcaattgaggtaagaggacaagagacgaggaaaaagagggtgtgccatgattttatccctcacactgcaagtgtcggtggggttgtggtggctgtagtgatgttcctgagcgatattgctattgctagtgacaggtacccttctattatcactacttctgcgcatttgggcattaccagagttgttgttgttgttactgagaggcagagaaagaaacttcctattattagtttccatgttcatcatgtccatctcagaaagctcactgcaactgttccctccaaaccctatcatagtttcaaagtaataataagttgtgtagttaaaacccttgaaaggaacgaaaatgaaagtgctctctctctctctctttttgtttcactctctctcaccatgtaaaaataactaaaactcctcatgctacatatataatatatgtatttattttatattataaaatagtaatagtaaaataggaatagtaaaaccaatagctgtatgagtatgtagctctactacctctttggcttggatcagttgttcctagttactagtccccaccttactgttttctcaaaaagagcacactgcatataattgtccagagagtactcccggaaatgaagctaaaaaatctgagtcctttatttgtagaaaactccaaagaacctaaatggatagtcagtcagaacaatagggatttttgggctcttggctctatagcctgtaaaaggtggtgggaatcagattcagattcagatttcagagtcctccccttgggaatgtgtagtctaccttcttccttctgtgcatcaacagtgttgctttgcttcttattaatctcattctctctctctcaaaaacactactaccagtgtgctgttgctgttgctgtgtgtggtgaatgcaggtggagacacagaggctacacgcagggttaacgtgtggttctgcaacttaactcagagttttccttcccaatgaaataagatgtatctatgtatgtgaataatgtgaaactccccctcttagctagctaggtctatgcactaccactgtttatgcgtagtactattgttggctatctatcagtcacactcacatcatgaaattaatggaaatggaggagagagaaaaattgcttcactctttcactaaaattatatccaaagtaaaaacagtactagtattaattacgtacttatatgttatgcttcttaattatcttatatttattccatttttaacatgcttaagtgttaaaatattcctaagaatatttgcaagatttattttatatatagatgtgtaacaattaagaaataacttttgataacaaaaaggattaagttaactttttaacaagtactatgttagattgagatgtgcacattttttgttagttagattggaatcatatcaaaactcagtggcttagaataacggaaagtgctaaaacttgttgacaggaataaaatttaagtatttttaacaaaatttaacgtgttattaattaagttttattaaatatattgatattaatataatataatatgaaaaggttttttattttagtttcactctaataaatagtaggggtaaagagaggtgttggtgtgattgaaaggaatcaaacatcaaccgtccatcgacacctatcacccatgtgatattcctttgggagatattggatctttatcactctctcacacataccacttttgctttagtatgatggaattggtatatattagccactaggagggtgggttaatgagaggaagacgacaccgttttgtaaattggaatccatgcaaagacacacatatgtcagaggggtcatgtcaatctaatcaaatggaaaaaaatagaggagaaaaatgggttggaagagatagacatagcaaaagaagcccatgttatataagatgttgccctcattgtgggacactacctgcgtcccttcctttcagttcattactattgcgtttcttaccttaccctacacgaatgattgacaatttgacatattgtgttttgccattttctttctcaataaataatatatttacttataatacaatatttatttatataccaaaaagaaaattgtactcagagtctaaaatattctttacattatcaccacagattaccatatattttttacaatacttatatatttttagaacatttacagccattatctttttattatactgtacaataattatcttataaatatattatttctaatattatttataaaaaataagttataatataaaatgcatcataacttatttcttgtaaatagaaccaaaaatagtattaagtgttatttgtgattatatgactattaaataatttaaataatatcggtgctaatctaatggtgcaaaaatttaaataatttgtattaaattttctgttcacattttatcaaacttatataccaaaaaaaaatctccatattgtctttttataataaattattgtgtataaattaagttatctctagagaaacttttgtaagtgaatttgagtaaataatttaattaattaaatcttattacacagagtttatattataaacttgaatataaatattttaagaaattattgtgacaaattataccaaaaattattttcatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatattatatttttttaatttaatgattttaataaagagttattttttatttttacttttcgtttttttaatctatgattctagcgaataacttatctttttttactaggttatcagtgtgatattcgtcaattttattaattattaattttattaaaaattagattaattatttttttaaaatattttttaatcacatttttcatcttacgagactctaaattgagatcttatgggatttgggctcagtcccaattgaattatatatattatatttcactattagataaagaagatgaaagatgaaatcaaagaatattaagatactgttgactttagatcaaagagttaattctcatccctatttttttatttatctaataattttaactagtgacttacattcaatagttagaataaataaataaaggatagatataaaaaaaaaagtaacgctttcagagttaatttttggaataatttaaatatttgatcactcgtttatacaagattacagtagataagtgcatcggttaagcatgacagtagatatttaatttctaaccatgtatacatacaagtaaattattagaaaaataactcatttctttaatctatttaaaaaaatcacttaaaatgtctaaatattaaaaaaaatagaagagaatatttacttttctttcacccacaccatgctcctgttttctatatttacccctttgttggacaacggacatggatgatttgcggagagtttacggagtatctctctctctttcatttctttttatttttaaaaaagttaaataaatttttagtgatataatttcttaaaattaaataatttattttgtgttaaaaatagtagagtaaaaaattatatttaattaatataaaaaatatataattttttatttaagtttatttatttttttatttgactctttttctgcttataaaaaatagagaattttttgtatgttatttttatttttatccattcaaattcaaacaatatatttttcttttactttttcttttttcttttttcttttctatctatttcacttctaatttaaacaaaacattattttttaaaaccaacatgttgttgatagtgtaaaactggatactattttgtgaagtaaaattttgagtttaagttttgttgataaaaaaattataattaagagaaaaaatcaaattaaaattgataaatattttacgtcattttcatgataattaaaaaaaaaaaaaacattaatttgtcggtggtgagttcatcaccctgctaagtcccatcctcatcggaatgatatggtggagtttacttactatccttagccaaccatgcaatgccatgtagtccacagaatcgcacagaatcaatggtgaatttatctacgaaatatcataatgtcaacttcgaagaagaattagggttctataattccaagacatggatcggatatccctatacgtttaataatataattgctttagaacttactgtaactaacgtatgatttactatttacagacatgataaagtagcttgttccacttgtaccctatgattgacaaattttatcaattaaggttttaagaaaattaaaagatatctatacttttttccccatagttgatgatatataagaatgtttatgtctacatgagatgtccctcaattgtaccactataacaatattcgagaatttagtgtcaaaataatgtatatatcttaataaataaataaataaataaataaataaaaggtggaaggaaattaaggagatctcgattccatttaaaggaagtgtcttttatctgaaggattttctttcttaatttttttattttggtgttagaacgtttttcttgtatttaagaatatgataattaataagtcattgttggagttttactcgacttaatcttctcgtataagattttggatttaagacttataaataaataaaataaaattatgtgtcaaggcttaaattttaatgacttattaatttatatatgttaaagcttattcttcttttataaaatgacttataaaattaaaaattatacaagaagattaagtcgagcatataaaatgactcaatcttcttgtataaaattttaagtatataaattataagtttttttttaattttacgtatataaaatttaaattttaatgcacacaaataacgtaataacaaagagagtaaccctgaaggtttctccgtgattgagttggataatgacttctaaatctatatatgttactatgcttcatgaaataagattttcttcatggggcagttagaatgaaaaagattgtcattttctttacattcagtgatgttgcaaaaagaacatcagctcaaaaaatgaaaagttaacaaaataatataatgactaatgactagctgattagactgtagatgcttaacttttttctaatagacaaatcaatttttattttttatgacaaaacattcttgctatcaaattgttgtaggctcgaggtccaatctgtaaaaagggttatattttagatcaattatcaaccaataatattcatgataagtttaaacatctggttttatttttatttttgtgataaacatctgtttctgggccttttggtgataaactcctcttttactttctgcgcctcattcttcgcttcatgcaccccatagaaaacttgaatggacaaatatgtcctttcttccccatctccttctcttgccacccaaaatcttccatagccaccaccacctaacccatagcaccagtagattcaccacccacgaaccacccaaacatcatcgtggccaacgccgtgctgagccatctcattctggcgcaaccaaatcccaacccattcatcacccacatgtgcatgtgcgaccactcacccatactcaattttgggaaaaagttatattttttggaattgtgctaacataattccattaaagcatttcctgaataaatgttgttttccggagtgctaacataattttggaaaaacatttctggaatttcttagagaggtagtagttgacaaaaaaaaaaaaaaaacgttgaccaacataatagaaaatatgtcaaactctttccactctttttctatgcctaggagttgtgatattccgtctgaacagtttggtatgaaagccacacgaatgaatttgcaaccaatcattggatgagaagagaaaacacgaaatagctaaaaatataccagaaagtaaataaaagttaatattacgtcattttgtaatattcacatggatagaattcgtacaaaaatcatcaacttcttttcatattcattcaattggtcgttatcttcgtctctttttgtctttattactttgatcacttacactctgtttggagggaaattgagaggaagaaagaagggtaaaaataaatgtcttccactattttattgagtagaaataaaggagaggaatgacatttcgtgggtttcatatgatttgacttccatccaaaaatataatgaaataggactaaaatttgctccttccctaaacaggccattgctctacttgagttgtggaatatcaaagcctttgtattgtcgttttcattcctcctttgtattgtctacttgaaattgcttgtcaaacaattatgaggtattgatctaacaagtttttcctatagacatgccatccttggcaactacttaacactgtttatcaactatttacactttaaccagataatactggtgcacggcacaatgagtcggagatcaaaattaggatgcggaacttaattggagataataaaaccccatgaattttcacattgaagataataaaagttatgatcctaataagaaacatagaattacaatttaccccttccccccaccacaaaaaaaaaaaaaaaaaaaacctcttgaagatacaagtgtctcttgatactagatcaaagcgagtaatggaggcactaaataacttttattgtaattcatatatttctttttttggccagcgaacaaatgagaggtagagtcattttagattcaacccacaaatggatttttttttccactatgatattaatataaaatattcattaattttgttgataattaatctttatctgaaaatctaattaactatttttagtgtaatttttctttcaattatattttttaatccacaatgttcaaattaaaaactttctttcagaaaattaaattaaatttcactaaaatgacttgttggtctcacaaaaatggattgaaagtaatggaaagattttttttttttatatttttattattagaattagaatgacaaaaatatctcaatcacattttattacttatttagagtatgaatgtcattttatacacacatgtaaagagagaagagagatcaaattacatcgatataattttgataattatttcataactttcaattgaataatgttttcttcaaacttaccattagattgaaagttattttcacatgtattacatgcaaaattttatattaatccaaaattatttgttactttattcatataaattaaaatcaacttaatataaacatttcaaaatatactaaaatatgaatcatttgattatctttttgttgttcaattttgacaaaagttgacatagacaatcttaataatatgtagatataatttaatagttgaattaataaaaatcatattttatatcaagttacaaaaatgatataatagttgtcaaaattatatcagtgtaatttgatccatccttatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcttcttaacaacttaaaactttcctttcaatttctttcattaactaaacataccaaagaaaaaagtgctataacctataagaaatgcaaccaccattattgtttaataagaaaaagtaataaaaataatagatctgttaattttgtaacaaaataaaaactctagtaattaaaaaaatattttgtatgtttatttttaactaattttattcatatgctttaaatacagattttgacttctaccaaaatagtacagattttgatagagcccatatataatcctttcacatgaaactaagaagtcaaaatacattgatgcagatagtaactcaaaaaatgtttacaacatattaacaattgatttcatttttcttgtattttatttgggaatcattgaagaaagaaaaaacagttagaatgtaaaaatcgattaacttcttaaaatcacttaaccaaaacataagttgaactacacatcaccctgcgccatgcgctggggtacacctgtttctgggccttttacatactgtttagtgtttgcatataactttcagagaccttttctattttgctttatacaaggttgggctccctcagtctttccgtttttcccatggtcttctttatttataaattacataatctactttcaggctttttccaccctttttcacgaattatgttaaaaatcaatggcagttttcaactaccttacggggtgattgtcgccgaacaaagttaggcactaattttcctagtaatttttctccattcacacaacatttctcttataaaagcaaatttgggataaggaatctactaacaatgaacatttttatcaaattcactaataaaatataagtagatcaatcaatgtttaagcataaaaatagtaatttcaagtcgactgaaaatagaatctggtaaacaacctacaacttttggatgacaactgagttggctataccagcttgttctatagtctggtccaaatcagcgagttgtttgggaggaaaacccattgactgcagttggtaacttcttacacccccgggtcttgatgcatcaatgaatgctcgaacatctctgattgtatggtggtgattgaagcgagaaaccatgcgtgtgccatcagccaacctcagttggattgatgtcactaactgcgactcatctacaactaaacccatagttggcaatggagcagtacttggtgaagcaccggttgtttgaataggttcatcattgctggagctggtgctacctaaagttcttccaacaccctggaaagcacgttggcgtggcttcactggttcctgcacaaattttgccaaaaggaaaaagaaatggtaaaaaccttaaaataggatgatagatagatgcaaaaaactaaaaaatagaaaagggaatacagggtagtcttcatcccgccttgtgaggttgacatggacagcagtcttcctatcttctggctcaagttctttgggacattcggacttctttatgctctatattgaggtaaacaaatgattagcatgctctatattgggatagctttcacacgttgcagtgctgaaagcagtagtaactttagtgtacttgaaagagcttatttaaagcttattttatgacatgagcacttgtataaatatttgaaaaagctcataaaaatagcttgacatgttcatgaactttttttaaaaaaacttgtaagcttatttcaataagttattcaacttataagaaaacaagatagccctattttatctttcattcaataagcttataacatatacataagtgcttatttgataagcacttaaatcctatctggataaacttttcaacagacattcataggagaagaaaaaaaaaatgaattaagcttctctaataagttaagattgctcatgcccaacagcacaagtcaaaatcgatttttggagaagttaaatgagagaagttcaataaataaacttatgcacgaggttttaaattgcggctgtggtttcatcaattttcatgaatattgtggaaagttgcaacaaatgcggtcacaattgcagccacatacacttcaagaaaccttgatgttgcagccaaaatcactatcaccaacctcttcttaaaaacttatgtataacaaaaatttaaaattcttatttttccttttttatttccttctcctatgaatcggcttatagaaaaaatttatgtaaacatatccttatttaataaacacacttaattaaactatttccccaaatgcacatacaccctcaaaagataaacataagatatggataaaagcctacgagcaagagcttttggaagcaaaagtaatggcaaactacctccagaaaaggtgcgttttgcggatcatccaacctccgtagaggaccatcattgacagagaacccattcctccagaaagtgacagtgtgggtaacttcctctagacgctgaggagcagcagcagatggcaatctctctccagatagcaacctcgccgtgccactaaaacttgtcgacctcgacgagcttcgaggattctccggaggtgcatcaacagcaacctgcctcgcttgatcaaagatatcatccacattgttgttgttgctgtttcctctggtaggatctcgaacaagcatcccactgcatgtagcatcaaatatataaacacattacaacgaaaaaagccacattggatcttattatctcacaatcgtagtcttagaatatgaatttgggcctaactcaacacgttgtctctcacttgtatattctattttggtcatatcactagtaagatgtgaaatctctagcatacctcatttaccaggctagccgccacaactaaggtgggccaggggtggttgcaattaaggcgactttccaacaattaatatgatcaatttacatggatacctcttttcgccgccggtgtagtactcgtcgggttcgaaatcgggatcggaatcggaatcatcatcgcgggaggagcgtttgagatcgccgagggtgcgaattttgccttggcggctggtggagggtttcttgccgagagacctgcgggatcggagctcgtagggcgtgcgattcggcgacggagacctcgaagggttgaagtccggggagtgagaatcggagggaggggaaacggagttggggtttgggtttgcggcgacgacgacgtcgtcgttttgaaggatgagagggttgttggcgttgtcgaggaaagtcgaaacggcggcgtctaggtcgaaattgtggctctccaaaaagaaaagggcttcttgtttggaagaggaagtgatttcgcagaaggagttcaccaaagctgcgttaccatcgggattctctttctctccttccatcttcttttttttctcttcactctgtttctttctcacgcacacttcacacttcacagagtcttttacaatgtcctacgttgtatatatatatatatatatatatatatatatatatacatatatataatacacacacacacgctacctcacttgccacgcaatcatacgtacgacaccgttttctacacttttcagttttcgctttatttcttctactcccgcaggccacaacgggtaccttgcgtggactgttgggaacccaaatcatctcctatcaaattatcaatcttcattaacgcagctatttttttttttttaaattatacaaaataaaaatatattacgcatattttaagtgagattatttttaagaatgatttatgagggataacatgttgaatgactatcctgttgagttattcttcaatgactatgatattaatcctaagaattactcacatcccgaggataataaaatagtccttcaaacaataatttctaagagttattttgatatttgattttcttatttatttatttatttatttatctttttaagttttaatctatcatttccatctttatttttaaattgaatttcaataattttttttaaaaaatagcaataattaaaagaaatattgtatcacatataactttttttttatcataaatttaaaatataatttatatgtttaaaaaatttatttttataaaatttatttttataaaaataaatgttttttaggactagtcttcccactacgtgattaattaagggtcaaattttcattgagagatgtttctatatttaatgttggacaatattctgaatagaattgttttaaaaaaaatcgtgaaaagtattttttttattttaattttctcacaatttttgctctcatttattacaagtaattattgtgaacatctatatgacttttggtgtgtttttcggtaatgtttgtgaattatgaccatataatttgactttttcaattatatgggctgagacttatctaagatgtctcctggatttaaattaaaggaagacctcacctttttacattataatttttttactgcagaaaaactaaatctgaaaactaaaattaaaaaaataatttaagatattataaaatatgatgttttcatatattataattgaaggaaagactttgcatctaaagaagactaatcatccaaccacatgtctgacaccgggaatttatccttattagttacatgttgtattttacaatcatatatggtatcccttaattggcttacaagatcaaacataagacaatagatcgatattacacatggaccataaggaagccactgaagtaaaagacaattagttaaaagaatttcccatggctatgttttgctgaaatttgagccaaaggtgacttcatgtccttcttactacatgtggcaggagcaaaagaaaaaaaatcctatcatatatacattgtttaaggattgtttggtatttcctcttttcagttttcacagctctagaataatgttgaatctcttgatctagcaaaatctgaaacagaaacaacatgcattatttaaatagtaatgcttacaaaatccatagaagtgcactgaacaggtaaaacacacaaacaccaaccaaaaagaaatgaacctttaccttcaacctaagctcaagttagacagtgtaattgcatctgaagtgtaataacctataaggattaatgacttcatgactattttgaatggtgcatatgttgaggcagcagctgcatctattatcaaggatataggttggcgagcttggagacaagcacctatatcaaatggaagcaacctagaaccataaaaaataagattaactccaggaaggattgcttctttactatcattttcttctggttcagtttttatcgtattggttgtaacggcttcaagggattctttaattggttttgtggcagcttcatgagcaggaagtaatgtgtatgatctgcatgcaccatttaatagtagacttgggatgattaggaaatcaagattgtgagccatacagaaaaatatctttttgattattgtttgccaagatattggtaatagaactttatctaacaaaaaattaagaacctttaagcatagaattgatagaaatttagcaacaaaactaagaaaattgccatcacagctcaaaacttcattttggcaatgttgtcgattaacaagttttaatctctggcgcacacttaatgcgccagaaatgggagaaagatccactagtgaattctatcttccactggcagggtccataaattgtccaaaagcttgctctttctggtaaagaagctttgtaatgggacctgttgcttggtacccatcacaaatatcatgcaattttttcctttggttttgcatttcatcatagtgttcaccaaatgagccagattgaagcaactctgatgaaactatccttctacatatactaatgcacaacgttggacttaataatggcattccaaattcctcactcaatggcacccattcatatatctcttctgaataaaattggtctgattttgttccattaaataatttcaatagtctaatataaccaacagtccacaatttcattttgttggccaaattggtcaataaagaattcaacttagaatcttcctcttcatttagtcctaactcttttcctacagagggaattgatccatcggcattcttcaagggcaaagggatatccaaagtaatcaattttccatattcaataagatcacatctactaagaggcagcaccaacacagctgaatgtttaagaagtgaatttaagcactgcaagaggatacttcccttcactaaatttccttcaagcttcctttgtaaccctcctattgtggaaccatcccaagaccatataagggatttctcacaacaagcccatggcgcaggaagcaagcgcaggcactgtcctttcatcagaacaactgatagagggccactacctgcagttgagtataaaaccaatttcatccaaggactcagaagaatatgtgggaggaccaaaatgaactagtgatgtctaggaagaattgttgaatgaggaagaggcactatggacacaagtataccatagtcgcgaagaaacaaatgatcaagagttgctggtgcaagagaagccaaactttcatagcgaagaacgtctacacgatatttcattttcctttttagcattcctgtcttaacatctgaactttcaaatactgctagtttctcattacaatcaaattttgtgtgtgccttgtcagcttcgtgaatgtgatcactgctatcctccaaagtaatggaacgagtttcatcatctattccactaggaacacggtcggtgtaaatagaagcttccacaagcttctatgaatcagaatttattagatcctcattatttatcagagtttctaaaacactacagtctcccgatttatcaaccaaagaactttcagctatctcagaacttggcccatcattacttgaggtaatcagcttatcagaacttccctcttcttttatgctggtaatattcaacctgattgtagacactctaagacacaacgtagactaaataaatggttagcaaattcctgtaattctccctcatatgttgcaccctccaaggtactaagatccttgcaaagatcagcaatgctgccataacccaatttccctgcttcatagtgtgtaacagcatgagatttcaggcctgcaaagtttggcaagaagtataatttagtcaaacgcaaaaaccaattttgagacacacaacaagtcgtaatacaacaaagccttatcccactaggtgagatcgactacatggatcacacgacgccattcagcacagttaaaaatcaaagtttcagaaatattattaacaagtcgtcatgagtagtcaaaattttattttcttcttagtatttgtagagaaatttatccaagtcgcctttaagaataataataactatttaaaaaaataaaactacaggaaataatttaagcttgaagaggctaagagtgaagggtataaacctggtgaaacagatcccatcataagataggatgtaatattagcatcaactatgaaagcaacacaagtgtaggaagaacaaggtccattgtttcctgaagctgaagcatccccttgttgaatggagtcattagcaaagagtattctcataattttgactagcaacaaaagcatcttcatcactagttgtacttgcaacaggagatgcaagtatagtaactatagttgaatctccaataatagattctggatcaagtacttttgttgcccatcccaatcgacacacaaaagcagcagcagcttgcaactgtgacaaatcagcctgttgggttgttgccaactgccaagtccctaactgttacattttcatttgaaactacaaaaactgcatacaacaatctgaaagaaatagctctagcattagggtcaaactacatagaagtaagctatttgaacaaaattgtggaaacacaaactgaaacaactactttactcttcaataggatcttcataagactgctccctgttggaaacaaaacaaagttttattttttaatattatataatttgataaaactttttagataaacccattgggtagagagtaagaaattaattcttcgatataattcatttaatttgataaaacttatgtacgtaaataaaacattaacttatcataaatttcaattgtatagaaataaatatttatttaagacaatacacatattaaaatactacttaaattataattctgtaaaaagcatattttattattgattaaatttaataaaattaaaaaataattaaataaaaagtgagattcataaaaaattataaatttcaatttaattagtaataaaaatgtatgtttttaggacaataaaaatatatatttaaaagagcatacaagagaacgtgtgactgacttttctcttataaaaaataaaaaataataaaattcaaatatcaaaattgggccacatacatcatcagctttctctccctagggctaatttcctgtgaccaaattctctctttttaacttcactctatttttcttgcattttcttccactctcgtagcatcttctcactcttattctcaatgtaagttctttccacttcttcattccgtcaatttcttcacgccctagctcatgcacccacaatccgtgaatttatgagtacaaatttcactggtgtttttcgtggtatgggttttggattagggtatttgggtatgcttaaatcgcaccctcccacgtgtttcgttacttgttttcgataatgttattgatcgaggttgtgaacgtttgattcttttgtagatagttggggttgggttttttctagatatgattaaacagatattcggtaaaatacctcgcaaaccctcaaaatcatctcacaataattcaaacggggaaggagggttcaatgatggtttctcactgaactcatcttctaataccctcttgaaatccaattcagtttcttcaaaatcttcaagttctggttcagttgggtctcgttctgggaatgagactattgctcaacactattcaaaccaatctaagaaattagctcctagtacaggttcagtaatggcttctgcagcttatgaggctttgcctagtttcagggatgttcctagctcggagaagcagaatctttttattagaaagttgaatttgtgctgtgttgtgtttgatttcaacgatcctgccaagcatctcaaagagaaggacgtgaagcggcaaactctacttgagcttgttgattatgtttcgtctgtgaattcgaagttcaacgagtttgcgatgcaggagatgaccaagatggtggcaaccaatttatttcgcgctctgccttcttccaatcatgatggaaggttggcagacatgggtgagcctgacgaagaggaaactgttttggaaccagcgtggcctcatctgcagattgtctatgaatttctctttagatttgtggcttcaactgagacggatgctaagcttgctaaaagatacattgatcattcgtttgtgttgaggctgcttgacctttttgactcggaagaccaaagagagagggattacctgaagactatcctccaccgcatttatgggaagttcatggtgcatcggccattcattagaaaagctatcaacaatatcttttacaggttcatatttgagacagagaaacacagtgggattgcagagttgcttgaaatattgggcagcataataaatggttttgctttgcctttgaaggaagagcataagctgtttctggcccgtgcattgatcccgcttcacaagcctaagtgtgttgcactttatcatcaacagctttcttattgcattactcagtttgttgagaaggacgtcaaactagctgatactgtggtaagaggccttttgaaatattggccgataactaatagtgcaaaggaggtaatgttccttagtgagttggaggaagttttagaggcaactcaagcagcagaatttcagcgatgtgtgatcccactatttcgtcaaattggtagatgcctcaatagcttacactttcaggtgcttacaaaattcccccatatttattttttcatttgtgatatattctgtctgcattcattttattagcatttactaacacctgtgaccacagctctctatctctatttctatgttattcatttccattcccactttgcttgtcttagctatcttagatgctatcattctatttctctaatatttgatgattacttgtcgaaactgcaataaatttaacaaatgtaagcagctcaaccatcagatcagagcacttgtattgatactagaaagccaaactattttacattagcattacctttttttcattgccatttctttttcttttgagtaaatttcataatccacctgaggttttgtataattaacaaatctcccctatttttttaacatttacagtaatttccctttaggagagcctgatgtgatatttttcaaacaattgagggggtgccagtgtatacttttaaataacttaagggggttaatgtaatgtataaggggatgcaatgtatatttttaaataactaagggagattagtgtaggagtagaaaaaggcaggggtgtttgtgtaatttcatgaatctttagtggtagttagtgtttttactcttttcttttttttttttttggagttgggttcagatgtggcactgctgaacttttttcataaagatgttgtgactcgacattccttcttcctttcattattatttggatatcttatttatgccttatgaaataatagtttgaatctcacaaattttatgtcaattcataatttcattgattattcaatttttcttggaagttggacttgtgttgccaatgatatattatatatggttttcttttatgttaaatctcagaaatttgatatttattcataatttcatatgaaatgattattggattttgcttgaaagttgaacaacaaaatattttatatggttgtcttttatgttagaacttgtatttgtgacaactaaagattttgtagatttgtgttctgtgttacaagctgcagttctacaatacaacatactttagttttattatctggaatcagtctcaaagaattagattcgatgttgacttgattttgttggtaggtagctgaacgagcactgtttctgtggaataatgatcatattcgaaatttgatcttacaaaacagcaaagtgatactgcctataatctttcctgctatggagaaaaatatacgggaccattggaatcaagctgttcagagcttgaccatgaatgttagaaaaatattctctgatgctgaccaggcactttttgatgaatgcttgaagagattccaagaagaagaaatcaagaatagggagaagcaaacaaagcgagaatccatatggaaacaactggaagatgttgctgcagctaattctgtaagcaatgaggccatccttgtctcaaggtttgtgtcctctgttgcaattgctaccagtgcgaatcaattggcaactgcaggtggttgagagccatcagagatccaaattgtttgttctgaccacatgatgaggaacaaaggtgaatggggttgatgtggatatcaggctgctccttgtttctgggctttttcgtctccatcatctgttctggaatcatgggttgtactatgtatcataaggaatttagtttataataggcagtgtttatttagaagtctagccattgagattatgcagtgatacaaaaacaatccttttcttttgccatatttatgtaattttaatattagtaaaatttctatttcttttagccttttgcagaaaaagatctgaacccattgttccctctggcagttatttgttcttcgctggctgaactgcttgtcacaatggatccaatttttttttctttctagaggggggtcattacacgttcggagtttgtgcttttcattggaccttttcttatttattacttaacctttgtgggttgggttctttgggatctatgtctcctttccaattgaatacgtttgctcttcataacgaggtatttcttgtttgctctttacgtttataacgagacgtttcttgtactcgtctgcattttttttaatatttttatagaagtctgtaaaaaacaaattgaatctgtgtgcttaacactatgatgcacttactgcagagttaaatgttccactttggattatggacatttgtgattttacatcctgcttggaagacaaaaatatgaagttggtcgatatgaacttatcgggaagtcttgccttgccgaggcagaacatgaaaaggatacaacagaagcatttaggacaatttcttttaaatgatggcaaagtatcacaaacattcaaaaatattggtatatttagaaccggaaaactaaaactttaaaaaacatctattgcataaaacacccaaataagatgggcatgttacttttaagtggttaccaagcatcatcttctcatcaatgatcatcaccatatgctctgaaactataacgttcttgatatggaccattgaaccagaggtcagcttcaaaccactttgggtactggaccaagtctccggccacaaattgcatgaaacgctcgcttccttcaggcacaactctcacttccccttcttctatgtgcaccagttggtctacctgccagtcccaaggcaacctgcttttcccagtcttccacactgaccattttgaaactccaagctcggctagtctctcaggaggaacttttctttccaccttcacattgtacaattcctccaaggatttctctatcctcattgcttttatgcgacaccttcctttagaagcattaactgactttctgaaacccctggaaccattgttgacaggagaataggtaatggctaatgttgtcaacaagcttgccatgcctgttaacagtttacaataaatgagcttcacttgcaaactagcacaaatctgcaagaaaggtttcaagaaattcaaagacttccaattttaatgatgagcattgaataaaagttccaacaggaaccaaccaacacatttctctcttaaattaccatgagtaatctcagttaatttttaattgcaaagggtgaaaaactgacactataacatagccttccgttgattctgtagtagcacgtttagttatgcttccctatgtgggtttgtttgttttatttgtgtgttgtgctgtgtctgtttccatcatatatggctagaaaaggaaacaagtttccaacttttttttttcttgaaattttgaagggtgaggcttaccttacctagtacctacacactttgaaacccacaacaatggaatggaaatggaccagaaaaatgaataacaattgaagttcagaaaatcatcaatgttcacttccggttgttttaagtcctaattgtcattcactcaggagatatcataaacttaatgcacataaaaaaaatcttcagtttccaaagcacaccaatcaattacaaatgtaaaaacactagttttctaattagggtttggtcaagacccaattcgtgaatgcgtggaaagtgattaacatacatgatgagctccgatgttttgacttctgaattgaaatgaacaccgattaaagagcagaaaaaaaaaatgatcgaagtttttatcggttcaaaagaagcgcagggttgaagacgcagttggaagtttcgcttcgtttcaaccgttaaacgataaaccctgtgagaatcgatgaggtttatcctcaaacttgaaacctttattaagtagtaacagtggagtgccactctgttgcccacgcaactatatgtatttaatacgacctacaaatatttcatgaaaatatgttaacaaaaagtattaaagagtatattattaatatgtttttttcaaatgtgatcatgcaaaacatatgaaataggaagcaagcaaatatgaaaataaaataaaatagaaataccaattttttattattatttgttcaaaagaggaaatttaaatgtattctttttgttgtgaaataaaaaaaaaaccttctccccaattgaaatggaaggaggaaaatgaaaaattctctctttttttattttaatttcttaataagtaaataaattttcataaaacaaacaaaatattgaaaattaataatgtttatattaaaaataaaataaaatattattgtttttaaaattaattaaaattctaattaatctaaaaaagcttttatggattatttatttcttttcactatatcccattaataatttaatattacttcccatatcatatctaacaaagatatctagaggagtaacttagacatatctaatctaattaagtgaaaaataaaagagaaatatatggtaggaaaggacacagaccgttctggtggttgaacgtgtccacttgtggtgcgcaaatttgttgttgcctttttcaattatgataatgataattgataattgataaatcaaacagagaatagagaaaaaaaacagttgcttgctttacttcgattactatcttgtttatctaaattttttgagcttcatttgttatgttattgcttcggcttcaacccattaatggaatatctcagctctcggtggggacttcattcccacacaagaaatgtagccgaagacccctccttttgagatcacaagctgctccctccagaacccaggtaccaattcttcactgtgtcatgccacgttgtgttttctatgtaacaagtccaaataaagatgatgacattttatttttaatttaattgtattgcatgatagtgttaaggtttctacactaacattcaatcatggattaccatctatgataaaattacttttgtaataattagtcatatttaaggtgttttctagtttgttgacacaaaaatatttttacactaaaagtgtaccaaaattaaactcatttctttacttttatagaggataatggagagtgtttcagtgagtggagaagttggtggtgctggtggagcatactcatatgaagccttgaaaagattagaccagctatggtcaagcatatgctcctctcaagaaggttcatgtcattcaatgattcttataccctttaggaaatgagactattttatatttttttaatcttcttattcttatgtatacattgcagttgtgcaagagcctcagcaagttgtctctaccatcccaagcttgtttggctcatctgatcttgctgacaaagcagagggatcatacgatgtgttagtgtgtggaggcactctggggatcttcattgccacggccttgtgtgctaggggtcttcgagttgccattgtggaaagaaatgtgctaaaaggggtaatttcagtttcattgactgagatatcagcattcaatcctactcagaaaagagtcgataaattctttgaagggtcggatcaattttgagttgtctgtgttattttgatcattagagagagcaagaatggaatatatcaactaaggagctttcggaacttgtagaagttggagtcctggaagaagatgacattgaaagagccacagcagtaaaattcaatcctgtaattcctgaacttcttcagtttagtttccaatctctatgtagcaagaatcatctcggttaggtatttctccataactaatgtcttcaagtcattttgaacatacatcacatcattcacatgcctaaacacagtaagagatggataatgaggtcttgtttgttacaaagaaatgacaaaattcatagagcactgcaagatgaagttatctaacaaccaagggatattatcaaacagtacaaaaaattagcatgttatctacttagtaacagtaaatttagttgtcaatcccaagagaaaagacccaacggtgtttaattttgtatgaaaacttaagagaaactcatttaagcttacaaggtagagaaaaatgaaatacgtataccctggcagtcatactctgacttttgttacggttagataaatgttttattattaatatcctccatgaatattaattcacgatactttcttgtgttatacatgtgtgtctttgaagtaattaaagagtgcgatttttatattacaattacatacttaagattgaatcattgaataattttcatcctatttcaattcattcgttttttttctttttgtgcttaaaaattaagaatttctgaattttcatgtaagttgagttctcacaacatgaccattgcttacatattaagaagtattaagttcagtgcttcaatgtaatttccaaactgcttgattgttttttgttcctcaaagaacattcaatcaccaatagtttgttcctcctataggcaaaaaagctgtatcacaaatggcataactatgtctcaaatgtttccttcaagccatgtcttctcttgtaacctctctaggatttatggctcctactcttccctttaatttatttttcactaacttcactttggcaatttcatgaactatgcagaacagatgtggatttgaaaggaaaggggatatatgggtcaacgacatacttaatctcggtgtttcgtgagtctccttcccataaactaattcgatatacctgtaaagaaatataataattgttttcttctatttcaattatgaatgaataatttaatctttgttcttatctagttaatatttttcttttattttttgtctggcttggcaatgaacaatatgcggtcgcagttgctttaatttagtgcatgtttgaattatttatttttttggagaaaaatcacttctttattcaaaatctttctaattaagacttcgattataatctaaatctattttaaatacaaaatgagctaatttgatcacgtacttaattgttgtattttgtgtaattccttcaagagaggacaggaaatctgctgtagcaaactggatatagaattactaagaaatggcaagcagatgaaaaaaaaacttgaattattatgatgaatgcgcttccattagtactattgcacacaattttgaatattatctggacttggctctcagaaacatgcattttatttttactataggcgcggagtttacaattatgtaatttgagtataaaattcattattctgttgaaaatcatactcatttttgctatttgcaattgcagacctgcaaagcttatagagattgtaaagtcacggtttatctccctaggtggagtcatttttgaggggtgtggcgtctcctgcattaatgtatatgaggatattgcagtgagtttaccttaacttttagaactagttattctagtgcagggctttttcatcaagtgggggcttcaaacttagaagtcatgtcacgtgacatgatttttttttttcttctttaaattgcactcagaagtcgtaaaagtggttacgactttaaagtgataatcacatttacaacttctaagctatgtttcatttttatttttagttttttagttttttttttatttatgcgacgtactaatttcggtcgttatttcagtcgcatattgtggtcacaaacaaaaatacaaaaataaaaatgaaacataacttagaatttgtaaatgtggttacgactttaaagtcgtaaccactttcacgacttctgagtgcaattttttaaaaaaaaaataattaaaaaaaaagtcatgccacatggtacgacttacccctaaaaggtaatttttttaaaacctacccccacttggtaattaaaaataaaaaaggcccttacttggtgaaaaaaccatcacaagtgttagtttattaaaggccatgcagccgatacagaatttttatatgttgaatttctgcatatatattcgcacttacaaacaccacctaactagaggtaagcatcaaagggttatataaagaaagttactgtaccagaaaaaaagttgcacagtagattgaagtgcgacagtgaagcatgcaaacatatcatacatgaacctagcattgaaatggaaattttaaagtaccatttaactatgggactgaagaatgataagtttattttacttgatgataaagaagcatgaatgcatgtatttttttccaggttctgaaactttctggggacaaaatattgtcatcacgtcttataattgatgccatgggaaacttctcccctgtcgtaaaacaggtcaggaatatattttcattcattgttgtattcttacagacagttcatgattttcatcatgtgatcactaggatgttttctcctttcatcatgttatcacgttatacaggctctggctgtcatttatatgttctcctttgtttatctttgtaagggtgattgtcttcgagtgagacaacataaaggtcttctgttgtgtgttctatcctgcatatgtaggacacattgactaatatatgtacgtgcaagatcatttaatatgcatgcaaatgcaagtgatgcaatatctgttaaataagtaattagccaactaaattcctaaatgattatgagactgggaggataggaaaataatggtatctttcatccagtattattgattgaatcatcaccaatcagaatgagactgattactccattgagaatataaagaaagtttctattcattaaagttctacatatgctaacttgatttattgaaagatagacaagtacctactgaatataaaaattaaaaccttttcctgaagcttcttccaagtgtcatgttcaatgattttacagataagaggtgggaggaagcctgatggtgtttgccttgttgttggaacatgtgcacgtggctttgaaacaaactccactagtgatgtcatattcagcagttcatcaataaagaaagttggagattcaaaagcacaattattttgggaggtaacttttactatatcaatagaaacacagatccccatctctatttttaagaacttcaactgaaatcttcacaggcatttccagcaggctcaggtcctttggaccgtactacttatatgttcacttatgtggaacctcaacctggatccccaaaattggaagaattattagaagcgtactgggatttgatgccagaatatcaggctagttttcttttcttcattgtgttttctgatggctcgactttttattatttttatttttttcattttggaggacctatttatcctccccttgtctgtgcttcctttcttttctctaataaaaattctttttctatggaaaaactaagatttgaagtaaaaagatctttttattcaatgtcctgttcttaacagccaaactagaagcttgaaaatgccagtctgtgtatgaattatcaagtcacaaaactgtttgtgattaccttggtgttatgttactaatcaattccagttatgtacatcatattatccttgtcttttatctctgtttatttaaagagtatctatgcaatcagttctgtcatgattatgctaactgataaagttttacactcttcaaatattactttttgaaatcatataagtaaccgaaacgtctatatttgacctgatgcattcttctatactggtgttctactgctctcagcttgactgatgacaatttgcaacttcgtttagggtgtttcacttgacaatttggagatactgagagttatttatggaatctttcccacatatcgcgagaggtattaatttgtattagaagatgtatgtacaaatcagttgataagttctacaatagactccccattactgtcttatcacacacacacacaatttgttttctctgactgaaagttcttgcttcacttaagattgacacctgaaagcaatacagccagtcagccagtagtttgaccttaaagaattgaatactataagttaaaacacataattcatttaaagatttgaaccatgtgttgtgcatggcaactcactgtggaagctactaaataagtggaacttcctcatgcctgtttcataatgtctcacttcgaaattttcaaatgtttctttggctaacctgtcactgccagatggcactactccattaagtggaaataattgaaccatccaacttttaattgcacatcagaaaattatctttcaacttgatgtgtcctctgtctctacctaacatctgctatttcccaagttcgttttaaagttattttgtttcctcttatttatatctttacctatcgtttgtttaataactgcacaatgtttgatgaaatggagtacctagcagtccgctaccagctgcttttagtagagttttacaggtaaattacgttttacacttatgaagcctctataaaattaagccatctatgatctatcaactaatattaaagtaaagaagcttcattctctgtagtttggtgatgctagtggcatacaatcacctgtttcatttggtggatttggaagcttgaccaggcacctggcgagactgtcagctggtaagcctttcggtgaaatttcaaacttctaatgtatacttttgaactagttgaagcagatctattgcaatgttgtggaacaggaggtttttttatttttagtttcatagttttatttatgttttatctgtgagacgtgaaactatgaatctgttagtttttctgagtattgagtgaactccccacctccatttttctttaccttgtcttctgttttcagctacattggaacaacctagttcagtaaaatataatgtggctgaaacagatttaggaagttgttcaaacaagtaacagctatcaacaaaaactaggcacattgttgagataatctgattctttttttttttttccttcctttttttcactttattacaatgaaggaatacatgaagcaatcaatggtgattatcttgactcatacagcttgtcactgctgaatccttacatggtactttccaacttctctaaagactgtttcagcaactgtagatgaaactaaatacctggccaatattgtgtataatgcagcccaacttgagtgcttcatggttgttccaaagagcaatgtcagcaaagaaacagtccaatgttcccgcagattttattaatgaacttctttataccaattttagttgtatgcaggtagtttatttctctcatgactcagattataattttattctttcttacttactgttgcttctattttatctatcacttctgcagaggcttggtgatccagtgctccgaccatttctacaggtggacttcttgtccctgtctgaaactctggatatgttttttgctttgtatttgtgagatgttcttcccaaaatattcatttaattgagatgagaaccaaaccaatatcaaatttcaaacctggaacaatgactgtcctgaggaattatccattttttattgcaggatgttgtacagtttggtccactttccaagacattgggcctggttatgttaacaaatcctaaaatactcccatccatattcaaacaggtattcatgagtttagctatcagtaatttcttatttccttttttcatttcaagtctgtgtaaagatgaataaatacctaaaaactgaaaaaacatctcttcctacatgtttgtgcggctttgacagacatagctcgtaacataatttatatgttcatctcttagtttcttatgtcatttaattggacaaacaaacatctaacaactagttggaggtcaataaaaatatacgccataaataattagtgaagcaaccttttcaatataggggatttagcattttatctttttccaggttggtattcctgtacttcttgattggtccagacattttctggggcttggctactacacctttttatcgacctttgctgatcctattgtgaggtaaaagtctttacaaagtccttctaaaccacttattagcttctttacttattcaacaagcatataggtccaactaaaacacccttatattctatgcacatgttctatgtattgcaaggccatttttaaatacattaccatccaagacgagtttccagtggaagcggtatctcgaggcttggaaatatggagctggtcttgattacaagttatagtaactacttttacatatgattcaaacaaacctacaaaatagagatgatgtggtggcataattggtttttccctcacatccaatttcttgtggttgttctcaagatttactcttcatctcatttgttcttgatcttcaatggaaacgggaagttttgattcatttttaccactacaacatcaactcatcaagtgagatgacataaatgaaaagtagttttaagtcggagatatatcatctaaattgtccatagggtacggtgttccaaaacgaagcatgtaaagagagcaccaaatcaaatcactaatatattaggctagtaagaaacgtcatatctatactttctaacttatcatttgcaccaatgtgttttccgtccccaataaaatgagatgtttataatacgtttcatcaaaatccttagcgagcagtatgttaacaccatcaatttaataaataaacaggcattagtctataaaaatttgagttttacaactttctatgaaaagtgattataaacaataactttatgtataacgagatggtgtgtctacgtttttccacgataaacaacatcaatagcagcatacagcattccttacggcacttaaatggtggattataacgacaattacttaattatcattaatatgtttagtgaattcaggactttctttgatatagggtccattttaaacttatttgttaaaataatgttttttaaataaaataagcattttttttagtttgtttaaatcatttttacttaaaaaggtaattttttttcaagaagtaaattcaatctatttctaaaataacaatttctaaaaaagtattttgttcattttttttttaaaatttaaacaaactaactcttagtcatctcatccttataacatcttcaagaagcaatgcttcctctgtttgttttatctaaatctattaatttatatcaaaattatttttagcttcctaaattaatcttaactatgctttcatttatatgtagtgtatataaatatttaaataaaagtaagaatataattaaaagaacaatagtaattgatattgtcttaagcgagttatttccatcatgtggccaaagtcataattttgaatgcaaaattgattctattaaattttactaccaaacatgttagatattgatctcacgttgccaaaagtcatcttgttacaacagatcatggttttcagaaccttaacaatatgtctagtctgcttgaagaaacaaaaaaagaattgttgaattaaccaaaacaatcatattccgcaatttattactatctgaattattgacatacacactattttgcattatttttactctcctgcatgcttcaacatatacggccataagaatcgccagagacatactccatccaaattatctatgtttggatgtccatgccactatttccaaagcaactaaattaaaaggaaaacaaataaaattgtagatctcaatctgttctttttgcaccccaaagttttgacagctcctttatgatagtcttctgcttaacatcgtccctttccatatgccactttcttgacatattctcagcctgcaaatccaagttttgagttaggcttatgaattgaaatattcagaagattaaagaaatacagtttaaaacttgcccatatctttaagggaacaaattgctctttaatattctcaagttgtggctcaacatggtcttttcccttagttttgatgtcactcatctgttacaacaacaaaaatttccgataaagaagttaaaaatctaaaatggacaatttatttggcaatatagagatctattaataaaactgaaaaaccatagaagaaaaaacagtatcaatatacaataccaaaggcttatacgaggaagttttatggttctaaatatgtcattcaacatgatgaataatttatgaagaatggtgaataaaaatgcagcaagttaggcattcaagtgggttacttgactaatttaaaagcatacacatgtattaagaaagggagagaaaaaattgcatataattgaaatcacttacattctgcagctctaacttggaggccaccacaccaaataccaatgcaacaccaccaaatacaaatgcagtggcaacagcaaacgcctttccaactataaaattggaaattaaaagttgcactagcaaacataagcatcataagcaaagaatttgccaaaaacctattttttttttcttaacttcattattggtataatgagcataaaaaaataaaataaagtcatatctaatgaactaaacaaccacctgaactttatgtacaagcaaatcaagtataaaaaagtgaggttattcccgggcttcactatcccaaaatggtaggacattgatgcattgtcttcatagacatggtatttacaaactaaagcacaaaatcttacatgtatcaacagtgcaacttctggtgatagcaacaggactatagcaagtgatattgtgtgctataaataactatgacccccatatgtttctccttgagttcataatccaaagcaggtttctcagggtgctgattataactgctaatgccccactttagtttttcatattctaaatcatacttagtccaaaaacagagaaaatgatgcctattttggttttatttattaaccctattaccacacactcaaccctaaacctttttacaccagaaaagtaacttctgcccaaatagtatcccattacttcattcccaataaaagcaacatatattgtatgacttaactccctctccctcctcctcaatttctatatacaaaatataaaacactctaacctcaatctcaaactaaaaggtctgtcttatggtaacactcccaacaaataacaaaacattgcttaaacagcttaaagctctatacttgaggattgctcacttaaacttaccaatattgctaatttaatatcacacacaactacaagttttctactgttacagggaccctgtgaaggtttaactctagctcgtttagttgatgagaaacttgaaagtatcacaagttccctccctcaaattacttaatccacactctacacccaataaaataagattacctaatctcccccaaaacctttcccctttatactaccgcatcaactcaaactggttggaccaagtttcttagtagccacacctgatgctgaatatattggtatttcaactttgacatatttggtcaaagttgaacagagtatcacattctatagagggatcacaggatgaccataaattatggtgggccttgtctacaccccagttttccataaaccattatctgcaacagattccactatagagtccacagagacaggatgaggttatgtgacagatgaagtaccaaacctaatgtatgtaagtttgtcaagtagatagagtcaacaatgtacatattcatcagtgagaatttgcattagagataccatccatctacagttagaggaagttaatgagaagaaaatgtaccatatgcaagcccttcacctgcagctttcaacttctccgggttaacatgggtgctatatctgtcttgacgcgattcattagctgttgaggctgaaaccgtgtttgctgcttcaggcagttgccacctgtgtaaccaaaccattgtgcataaacaattgaacaaacaaaaccacccattataaacattagaaaagaagatgaatcataatcagcttcactgccctattaaatctcaaattataaaatttaacagagtaaatagcatacactaacagtgtaaaggatttttacaatatcatccaatgacaggccaccttatttgataagttcgttaatttttaccataattataatcttaaaagtcacgcccaacgatgatttctgattaattgagagtatactaataacacacaaaaattaaactcaatttaaaaacaaaaagttgaaattcaaatgggaaaacattatgcaaatgaaatttgattcataaagtgaaaagaactggggaattgaaattgaagagtgatgaaggaaccttttggggccaaaggagacttggggcagcgaaaggtaagcacgcagaggattgagagcatcaggggatacggaagattgggttttggggtcggaatgaaggacccatttggaggcagagaaggaaaaagaggtggcttcatcatttctgaacactttggaaggaagagagtgccttagaacctcgggaagtacatccgcatgatcatatccttcgtgaaagttaaggttgtcgttggtcttaggaagagggtttttttgggctaattttcccacggcttgtttggattcctggaaaaagtacgcagcttctttcccagctaaccttcctgcgagaaaactcatcttccagattactctgttacttctgtactttgtactttcttcccaccgtttcattacgtatttatatggctcccaagctatctactttattgaatttagttgaaaactgtcattaattacaagagtagttatattttcccaataaaaaatttcaaacattcaatcaataatttttttttatctttcttttttctatcacattacatcaattaaatatattacttatttatgatcttttctttctctttcaagttataaacaacttaacattgttcaacaaatatttttctaattaaattttttcatatatttgttttatccataataatcaaattcaatagaaaaatataatttataataactcacgtacattaatcaaacaactaagttaaagataaattattgtttaattatcaacaatgattggctcagatgattaaagatttgaaatgtttcattttttatggatgagttggaatctcccaatttgtgatttaggttgtgcaagaatcttttaggtgtatctttattgatagtttcaacatgtcattagggtcctcttcttttattttatcatttttatttaactaaaaacaaatctggttcaatttaaaattattaatttttttaataattattttaaattttatagtaagttttaataagcttttttttttgtgaactaacttttaataagttaatagattaaaaaactctattataaaacttttttaatttttttcactttttaatagattaaacagtttaataattgtcaacttatcctaaaaataataataagcatgcattcagcataaaattttatatattgtaaatcaattaaaaatattttatatcacttttaaattgattaataataagttagtgatatttatgattgaatttttacacacaatcaatttaaatatgtatttgtttattattaagggggttcaattcatttagttgaatagcgtgtctaaatattataaattttataatatttagatttctacaaataaaaaaatatatttattatataaaaatgtcagtaacatgctttctaacacgttacttttttaatgtctaaatacatattacataaaattattaaaaattacaaaattaggaagaagagtttaaaaagtaaataagattacttccttttaaaaaaaaaaaacttattttaagtaaaagtaatttnnnnaaaaaacttaaacaaaacctagaaatttttgcaattttccatgaattttaaactataatgtgttactagcctaacctttctctaaaatatatcttaacacgtatcaaaacaataaccttgattattatatatgttgtaattcaggaagatcatctgcagaagtgataccgtgtaaattgctttgtataataaaatatgtgcttattttattgtatagtagtattgctctactttcaaacagaaatgttgactataactctataagcagacccgagagcactaaaaaagattatctaattacttgggaagcaagaattgtgcacatccctattgcagtattgcttggagaaaaagtttcagtttgacatgctgtataacaaatgaaatattttttatttttttccatctttataagaattaaagacacgtattaattttttttttataacagtttatacttttctaccaatcgatcgaataagatccctttgataaatgagatggtcttgatagattttggacaatcaccacatcctattacttcttcatattttgcagaacgaaaataattctaatgttattattctatttgatttttttttcttttgtctttaataggtatttccatagatttataatatattcgtaaatgattaaatcttagaaaataattatacttatttttcttcaaaatatgaagaagtaaatatgcttttagttatgagattaattttttagatggaaggtaacgattaaatttatctaaattcaaactcctactgttataagtaaaacttatatccattaattgcagtttttgacacactgtaccctacaacaacaacaacaaaatggctattgagtattgagtaacgttgatgatagagagagaagttgtaaagttggcagtacgtgccagtaatgcgcaacttaattctgttgcagtctgtgtgcacgtgtttgtgtgcgtggagattgtagacataagattatggaatgaataattaccaaaaataaaatttatactacaatgaatatgtgtcggtggtacccaacttagttttatagcccatttattttgtgacaatttcaaattttatcgtagggtgtgtttttttaatagtaaattatatttgtattttatgtgtttttttttcaaattatatttgatatttttttttatatattacttttacatcattctattaacatcattaactaacgtcaattgaaatatttgaataggtgaaattagagaaaattacattaacatctcctgtgtttttttttttttcaaattgtacccgatatctttccattgaatctaattctgacgaacatgtcaagattattgatatcactgactccgatgttgtcagtgtccaaggaatcagacgcacccgtgatgatggctgaagctacgatggtggacgaggaggtggtaaaagtggatatggctgtggtgacgactgctacaatggtggcggtggctacaatggaggtggtggttgttccagggagagtggatacacccgaagaggggttgctgctgttggagaagaaggaggaggagaaagagggggggggggggggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggggggggggggggggtggtaaatgaaaaagagttgttgaagaagagaagagtatgtgaaatccaagatatgattttgaggatgaagatgagggtattttaaacataaattttcattaaaagttgtttattttctgataagttattaaaaggtatttaagatgaaagagatctgagtgtaatatgagttaaacaattaagaaactttttttaggatgaaaaaaggaaaagtatcgaatataatttaaaaaaaatgtagaaggtgcaaatataatttacacttttttttcattcagaaactctacaggcactagtatgtgactctctttggataacgaatgactaacaaaagagactaactttactgatataattcaatttcagatatttactgtttcttttataaaaaaatcaagaattactatcacaacatcccacaatttcaatgaccgaattccctcttaatttatacagataattagatgtggtttgtttatctaatctaataagagtttgtctaattgactcaaaataaaaatgagattaaaaatttttatctttaagatatttgtcttattattaattttattattaatgtgattattactatatttaatgtagcatcctttctctctcatgttattaatgtgattgaaatatataaaaagcagtttttcaataacaatttacttttatattagttaattacttaacgtctcataattttagttgttaaaaatttgaacttagctcctaactttttaaccactaagaaattggtttctatatatatatttcaatcactaagttatatatatatatatatatatatatattaataattacgttaatgatagaatttgaaaaagacaaatatctaagttcaattagcttcttcattccgcctctcattgtgaaacacaaccttatttctctgttcccaaaccaccccccacttctccaaaaatcctctcctatttagaagtctcctccattcacattactgtttttttcaatttgggagtggtgacaattgtcttcaaaataatctcttttatagtttcaagctctaattattgtctcaaattttcaacacctttgaaaatctcatcctcgttctttcaaagataaaatgttgactttccaaaagtcaaaaaagatattccatcaacttccaactcgttagaaatttaaattgatttttccaaaaatctgttactcaattaaatttccaaatctcatcactagctctcatgtcctgcgcatcgtgcttcaactgcacaaatcttattatactccctgccatagttttgattttattattcatttatgagtattaacactatttgtacttgttgtaaccattgttagttaccactcacagaaaacatcactaatcacttgactttcacattgttagttaccactaacagaaaactgcacaaattatcgtctctcacaaatttaaaacctttaaaaacctcaatccctttcattcaaagataaatatagatttaatttcttcggatcaacaaattccatcaatttacgatacattgaaaattaaattgcttttctggcattttatccacacagtgcaattggcacatgcatgctggttgtttgccatgggctttaccactctcgtgaaccttaggatcgatggcacagggagcccctcattagcactgtacccacctatgagtaataataagagtctgccactagccatgtgcatttctataataatcaaatctgctgttgacacaaaataattactattttctagctatgaataattaactctagcagggattcaagcttctattttagccctgttcagataaaatatataattggggtttgataaaacttgacttattgccaagttatctagctaaacttaattgtcaaatcattcttttaatttcctaattgcacatttgttgaataaaatcagtaaagaggacaggatatatagcgatcaatgatggtaaagaaaataatggtgatgataatgataatgatagttatactgttaataattatatgaaagaaatgtggcatagtaacaattatattgggtcttttgaaagaaattagaacagttccacatgtaaatcatgcttgataaaccatgcaaacttacttgagataaaataaaggaaagagggtgaagtgaaaaaaaagtgagttcacatttcactgtgttgagacatgatgagggccggataggttttatattactatttataagacaaaatgatttatttttacaattgacaacaaaaagttaaagtatatttttagaaaaaattgagttaaaaacactttaaaaaattaaattaaaaatgaattttagagctccaacaaaaatccagtgcgaaacttaagatttaacgtttggcagccacttatatcagcattgctaaatagttggcaaaatatgtctagaagttaatagcatcaagtttcctaatatcaactaacaaaaagatcaaagctatatctgtctatatcatatgtaatattaaggtttttttttcaccaaattatgtgacatttttatttttatttttaaattgtttaaaataattttaatttaatcgtttcatttaatttttgtttattttatgcatatgtttctaaaattttcatattcccactttcacattttaatttttaaatttttttggagttatttttaattttttttaaacaaatacacttaaaaattaaattaacttttagtatattgaatttttttaattatatatgttaatattaaaatgagaaaaaaagacgtattcatataatattaactaattattaattctaactttttggttaaactctatcatcgttcttttagtctttcacatatattattttaactcctcttttaattttctcatattattataaaactctgggtcaatatattaaaaaaaaaatcttgaaagaatggaaatgcaaaaaagtgtctctctctctcttgtgtgtgtgtatgtatatatatatatatatatatatatatatatgagacaaataaataaaaaataataaattaataaattgaaaacaatttcaaaattagcatttttaaaaaaagttcatgtaacaattttaataaaacttttatactctagctagataaatacaaatggtttgtgattaaaaatattaaattcttaaaaatactataattatacggttcaacgcacaagcatacaaatactagttcctttaaatcttcaaatgatatgattaggactaatatgtccttgagacttccaaggagggaatgaccttaagcaatgcttctttttccattttctttttctcttccataatttttatcttcttaggagcgtttgttataagaaattcttttagtttcctattaattgtgtcgaaatgtattctacgtatacgcaccattttgctgggcgtatatgtacatatttatcaaaaaaaaaaattccaaatacctcacagttaaaagaatgtattatgtatgtatctattcgcactctccaaatctctatccagatattttactaattgattaagatgcctaatgattaattaggatgaagtatgttttaggtgtgagttttttttatataaaaaaaatcttttggcgtgagtcttggataaaacaataacaataggtcattattaatctatttatcataattctgttaatcatgtgatcattacatataagtcatcgatcagcatcagtttcacaatctacatcaaataaacctatgataaaatctatttaccattaaaaggttgatcaaatcttaaaatatttttcattttatatttttaatataaaaaattcaaaagtgatgactattcaagattccgtacccagcatgtgctcttaatgatcaaatttacaaatcttttaacaaaaagtctattaattatcacaagactgttgaatgatttgcgtgacgacaaattaaaaaattatgatggtattttacacattcatccttagtttaagaagcatgtctgcaatttttttttttaaaatactttctaacattcatacaaatatttctaatgtaaatctcataaagattgcccctttttaaaataaaccaataattaaaaaaatatttctaaaaaggttaagaaattaaaaaataaacactaaaagtattattgttaaattacttgaaccaggttttttaacaccgattttcatgtaatattgattaattttaactaatttttaatttaactagtttgactatttttttgctctactgtttttttaattaaattatgtagccagcacgcagtctaacctatgttattaaaaattatgaagaaattatgaaaaatgtaataatagagtagcagggaagctcaaataaggaatctattactattaccgtagctagcgcgtggatgggtcgctaaagcaatcatcaatattatttaatgtgtttaacaagaaattattaggtgatttgaaattattataactcaattaatcggtgtatgacttgtaatgaaatttattaattctttcttacagtacaatgaaacactgaaatagatgttacaaaagagattaattagcacaataaatatgtgatgatgtgatactatttaattctttcatcttataataattgttgtgaaaaattattttaaaataattttaattttaatttttaatgtaacattaattatactttatgacttatatctcttataatactcttataatattaataaacaaaaattaaatgaattaataacgataagtttatttttgtaattctcttctatctatttattagattttattggtctttgtgaaagaatttaggagacaattataatattatgaagaaaataataattttttttattaacatgtatttattatttagaagtctagcttaattaattaagtaaaatatggatgatagaaaagtgacggtggcatggccaatgttaattggcaattgacactacctctcattgagtatatccaacaccaacatattatgttactactttttattttattttccaactacacaattatttcacacaaccatggtgttcaaaaatcaacacgcgcacaccaaaaaggctatagctggagatggtggtgcccttggtgggcgtcctgtaaccagaattagtatatatgtgcacttattccacccgtgtggaccacaaaccccaccttaatttcacaccaaaaccaaatagcttcccatatggattttgtgtgcatgcaactatggaagtgagatatattattatacactcactgtacaccatatatacttgtactcttttttttttttttttttttcnnnnnnnnnnnnnnnnnnnnnnnnnnnnnnnnnnnnnnnnnnnnnnnnnnnnnnnnnnnnnnnnnnnnnnnnnnnttttataattaatatatatatatatatatatatatatatatatatatataagcacatgtgtgaagattttatcctcacatgcaaagttaatcaagtatcattaactatatatacttaaaaattaaggacattcaaacacataaattataatatatatgtctttcaaacttgccttaaagaggaacatatctgaacactagcatcgtaaccctcctgttcacacttcacataatatatagtatttccttttcgacattatactaacatagtatgagaaattaggaaaaaatgtgttaatgggagggatatttatgctatataaattacggaaagttgtgtagagtttaaaaaatcagaggtaacacatgtaatgtgttaaatctcaatacaagttgcctaaattataaaaaaaaacataattaatatttattgataattattacatgtaaaataaataatatttcaaagggtcaaaattataaaactttaaaattaataacaattgaattctatactaagttaacatgtgatttagcttatgtaaaacttaatatcaactcttacaactagacaaattaaacaatttttaaatatcttggttcatttcaatttatttattttcttaatggtgtgtttaaaattatgtttcacttggtgcgtgtattaatgaataatgagacactaattaaaattggatttttnnnnnnnnnnccatatatacttgtactcttttttttttttttttttatcctaactaccctaccattttggagaaacaaattagaagtgaaaatataaaaaataaatgtacaagaggttctgggaccaaaatgttatgtaggtagggtgagactaagaacatgtggagtctatcatcttctggcaacaaatattcttgtgtgtgcacaatatggtggagttttattaattatttgcatggttgttgagtgaagtaatgggtatttaacacagtgcattcaaggtttggggcctatgacaccagaggaggtataatgacttaactgtttgatctttgatgcctgccatttcattttcatatattaattttgaactcaaaaactcaaaagcacccccccccccacacacacacacacacacacaattgaattgatgcgaaacccaaaaaatctgtgaaaacctgttagtgaactatgtgttctatattcttcttctcaacagttgttttcaagacataggcagaggaggaccaagaaaattgaaaaatgtttgctaatgtctgatggtggatcccaaagtttgaccaacaaaacctcaaatcttagcagtggttgcccaagaaattgtaactcatttgacatgcaaccagttgtgaattatggagacccttgtttgattttgagccatggaagaagcaaaactatgattgtataatgaataaagcatacaattgcgatcttaaaaaaatttggcttcttcaattgcaataaaacaggaaagtttggttaaggcaaagaaaatgtataaaactgtatacacaaactacaatttataatttattgtttcatacttcctaaaaactcaaaatgctctctttaccttctgtacaaggactctccactaatctagctaattaattaacaatcatatttctaacatgacttaaaaaatgcaacttgaattctgctagcatataatataacatatatattatatttgtatttccctgtatataacaaagaaggtagtgaataagaaagaaaccatatctgattacactatatatgttgctgttgccaccaaaatctgagagagatcaagctatctatctcttgttgtgtaaagggttggatcccgttggcactctgcgtttctcagacataaactctctttctctgctgcttcggattggagaatttgcccacggatgaaaatcttgatggcttgaagttgaagggcctgagaatttgatcctaatggcatgaatttttggtgtaaggaagagaagagcgaggaagaggaacaagtggaagtgtttcatgttcgtagttttttttttttagtaaggcctcggagaaacaaaacacaaagtgatggaaatgcaaaagtttggtgtaggctaggcttgtttatgttgtgtatatatttatatggacaaggttaggtccaacatgtgtatactaaatctggtgatatttatgaaaacacttgtggtgtttccgtgtgagtttgggtggtggggcatggcctaattgccgtgtgattgtgatcaaatggtcaattatagatatggggatcagggggcctagaatgacggttgtgggggtggtggtgtggtggcaatattcaatgagatagtgacatagaaaaatgaacacgaactcataggaggtgcatatatgatgtgaaagcttgaaggcaaagagaagggtctttgattttgtattgtgaatgaccaaaatgcccctgttttttgtttctgaaagagtcaatgcaatgaaagcacgcgaagtatgctaggggcgttttcgtcatgaaaagtcaaacctcgccgatgcactcaattggccttgttggaacagcaagcagcgagaggcatgtgggattgaaatagtgctgctatctaattaatcaaatagaattaaaataataaacatgttgaaagggaactatactagattactaattaagcttatacacatacacacctccataaggtaggttaagtagatccgtatttgttgggtctaagtcaaaatgtagattttgaggactggtcgattttgagggactatatattgttcttaattcctacccaccatgcaagcttatgtaagaattatagttttttttgttaaaattggttttttttaaatattagtaattataataatattttaataatttttttatcaagatattgatacgaagtaattctgtcaaaagtaaagactaatattcatcgagaatgatgaacacacacaaattgagttttcaacacgatttatttcatacccaaggataagtcaagatttgaagcttggattacttgattaaagaatataaacttatgttaatttgttgataatactttgatgatatttattactaatttaataattcaaataaatgaaataattattgtatttatcatttttttgtgctaaaaagtacccaaaaaaacatgataactactttagtctttttctttagaaaaaaaatactactttagtctctcataaaaataaatgggagacgttttaatttttttgactaatttaaaagtaaaaagatatttgtaatgataccgtaatctctttatgaatagtttaaaaaatatttgacttattccgctaacagaccaatcaaaacctctcccttcttctattattcaagatacaatagattatgggtctcgtaatgctaatagtcttgtattgaatcattgagccatgtataacgcatgtaattatagtatcatatatttaaactataccaaaaaaagtatcatttagaaaaaatacatgtcaataaagaggagcacgaattgtcaatgttaaatctagtggatattgatgtatcttcttgcacgggtgagaatagggaaaggccaaaaaaggcttcatcctgaagcgtctcggtgaaaactcgtttttatgtggctttttagcttttggtatggcaaaagatgaaaccataaataatgagaagaagtactactttcatgttctgtgttgtgacttagctgttttacactcaaagctgtaagcaatattcctcaaaagggtatgtatatgccttatagttaaggcggttaggttgggcgttaattcaagtttaaatgttggagacaattcaatagtcaagaattccaaaagggaaaataaagtgatagacaattagtagtttagagaaagggatattgatttgaagaagaaatgcaagttccttggcggaaagttatttgcattatcttgctaacaaacaaaatggtgatccttctttattgcgtttagtggtttatcataattcatatatagcatctccaatatgaagtgcgagaaaaccacaagtcatgtattatattattcataaggttcaaagagaaaattaaaaataatataagaggtcaatagatgcactttttaagcttgtacggttcaaagctattgttttctcatccaaacaaagtaagaaattaaaaatgtgatggcactgaaattctgtggtccgcccacaaatgcagataaactttcaaatatgtgttcatgggagcatatgcattttttcacccacttttgaaggggcatgacaaattgcattatattatcaattttactattctatagtgtaataagagtaattaaatctaattatgtaagattaattttagcggtcattgtttaacgaattacttatttttaaatattgttgtttattttttttatcattaaaaatggtttacgtattatattagattatttaaaattaagttctgattacttataaataaaacattttttttgccgtttgaaaatcattaaaaagaattaataatttaagaattatttaaaattatatcattaaagtaaaatatataagttgtttaattataatgtaacattttaaagaataattaatataagataacaaaatcaaaataaattatttaaatttcatcacccattaatacaacactaatattttttaatttcaaattcaaaacaatgcttatcgtatcctcttcaaattcaagaaaaatgaaatgagctgatattccaactggaatgaccccacacaaggagttaatccataccatattatgcttttctttccaaatttcaagttcatcgacatgttttattcataatgtatataactactattcttatgtaagggacatttatgagtattattaggaactaatgagtggtttcatggtgattcaaagtattattttcatagctgtcacatacagaagaattaaatctaaattagaagatattaataattaatagttttcaaatgtatcgttgactattatggtttataattaaacttatgtctcctcttgtacctactgtcaaaaccaagtaaaaattgccattatacatatatagaacaaattgctaatcagtctctggattcaattattgaacatttcagatttatttgtacgtaagtttaaacttatcttaattttataattaatatatatatatatatatatatatatatatatatatataaacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagtgaatataaaaaatatttatatcaatgagtcatgatcaaagtaaatttgacatcattttttaatacaaaatcttaaaatttaagtttatggatcttctcttcgatgctcaacttttttatttttatccattataaaatttcatcttgcttcaacaaaaattaataaattaaaataatatatttcaacatactttttaatcatcactaaattaaatatttcacttatatatttatccacacatcacatcacgtaattcatatatatatatatatatatatgtggttatatttataaagaaaaatctaattatctaaaagaataaagaaaaacctaacgttaattacttagaaaagaagaccatatactacatcaataatttaccagtaccgtaccagactatatttgattgatatatagttgtatggaaagtcttatatatgataagataggttgtacattattcatctctctagctagcctgaaagaaattgctttccaattattatcgattaaaaattaatacaacccggagcatatatagttcatgtcctttgcaattgtacaaacacatgcatggccaaattgaggtacgttgcctcaacacttaagagttggaaattaaaccatatactttttcaattagcccttgcatgagtggattacttgcaactgcaagctgaccccgatatatatctgcaacaacgtaaaacggtccctactgtttgggttcacatgcacttacctctatttaggaggaacaaaccaaactgtgtttcgacgtaactcgatttaacatcaatgttgtattatactaatatctgctgctgaataacctttcgaacaatgcttgcgcaagctagtcatcaatatccacaatatttggactaattaaagagaaagaaaactaattaaaatataaattagtgaaattcagaaaatatgatcaactctagctcatatgtctaagcaagtaacgtttcatgaatttgaaagatcatcacatggttatatatatatatatatatatatatatatatatataaacataagtattttgctggttgaaaaatgtgtatatattgttggagtagtagcaacgttgggtgtggcatcaagtccactagacctgcaaggcatcgtttactttgtgcggttgtttgtgactgtgatcagaagtcactcgagtggtttgttgaacaaagtttacttgtctttaatctttatgattccaaattacagataagtcaacccactcggattgaagtgctatatatatatatatatatatatatatatatatatatatatatattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatatatatatatattaagttgttggttagactataagttaaggaggaatttccatgagtctaggcctaatgaactttcacctaagcaccccatttcgtgtccccgatcttcactattttaacctaaatggtagccatttacacgaccaaaaagactacaaagaagattacaaacaatagttcttgtgtggttaggtaaggtttatcatattgaattagtatattaaatttggtaatctaaaaaaaacaattaaatgaattcatattagtttgattacatggttgattttatttctcttgtaatacaaattaaatcaattatttttggcttgattcgtatatttaactatttaaatttaaattaactcaccacctaaataattatttagttttaaactttcaaatttatgtatttattatctaattttacaagtatcttaagttatgcttactatttaagttttttttataacgtatgttttaagtagaaggattaatgagatatataaagtcatagatgtgaaaaagttatatattaattaaaaaatatcaatacttggaattgatttaattattttctggagatactaagaataaaaaatatttaatttagtgatataaaacttaaaattctatataagaaaaaaaagatgtaaaaaaacttaaaataatatatataaatttacttttttttgtttaatttggaaccaaactaatacaattaaatatcacacgtatcattattagcttttttattttgtgattactctacttaagttaattttgaagtatttatgtaattttcattttcatttttaattaaaatgttaataaaataaattacatattttctaattaaataataatatcaaattatggtgatacaaatcgaaggaaatataaggtttgcttaatgataaaagaagaagaaaggcatagagaagttgtggacttgatgattttgaatttttcactaatagaaaattaacacctaataactaacattgacacggataaaaaagaatggtgattcaaaataaaggacatagacttaagctttaatttgggatttcaagtttggaccacatatagcccaacaaaaaggaggcacccaatagaaaaaggggcaacagtgatggatacgtaaaaaggtgcaacttgactgcagctgtataaaacagctatgtaatgcttcagagcaactttccttaatatgagataataataattaccggctttctttttttggacagaattatcggctttcttaatacatcattacgaacaagtattctcctgacaattgttttcaaggatgatggattgcatcaatctattgatctgtaaccaactctctaatggtaactaatgaatcaacaattcctttaatgtgaagaatatatttagagataggccaagaatgttttatatatatatatatatatatatatatatgtatatatatattttagctatgaatgaagttgacacatttttgctccaagttgggagtagtaatactacttatatatgtaatcatgtttaattttgttcaaaataagattctattgcggtgcagcaccttctgtgcgccatcctccaaaactgaaaagaagattttaatttgacaataacatcttggcgccacattttatttttgcttttcacatgcttggattactataagattcagaatgattaacctagctagtatgccatgattcaaagagagacacgtaatatgaatacagtaatatatggaagaaacaaagtgggtggtccaaatcaatgaggagctcaatagtgatggtcctgcagcacctgagaagcaatgggagacgcattctatttacaaaattccctcacatgtcactgagctgaacaaaaaggcctacaaaagataaattaggaacaatggaaaatgtagaaacttaccattttcattttcctaagttctttcctacccatgtgccccctccatcggcattgtgtgacaattgaatctttcttgagcttcttataatatgaagcagctttgcggcaccgccaccgagcctgcaatttttcgagaattaaaatattgaatactgatgacccttatcaatgctcctaatcatatgttagccaactgtaacctgaataatgatggaagctttagtctgtttcctaaatctgaactctttgaaggaagcaattgcccttaaagctgtttgcaaagtaagtactgatgcttggagtttaatataggtattcctaacttcatatctgcgcatgttcttttgaattttcacagcagccgcctccgttctcttgatggtggaacatgatgtggataagaggtctattttcaaatcctattgttgaactacaatatagaaatgctaggtagactagatgggaaatattcttagtaaagaaagattcgttatgccatttttttattaagcagtttgttttcatttgtaaactgtgtaggacataccagaatacccttgagatcaatatagagggaggtccttgttcctatcatggatgagttcagccagctcaggtacatactttcctgaaaataaatagttgtattatttactattaatttaattagaataaatgatgacaaaaaataacttatgcaaaataataggtatttcaaatttcaattaattcaatacctgcatagctctccccagctatgtaaaatgtcctacttctatatgacgtcaaggccggcaacattctactcgacaccttcgccgctgtcaagctctccgacttcggtgtcgccacttgcttgtacgctgtttgggcatggttagcatttgccttgttttattttgtctcaacataacatgctctatgttgtcattaactttctcatgcctgcaggatggctcctgaggtgctgcaaccagctggaagtggctataattccaagtcagtcagtcattcattcagttcttctttttagctgcctctgccaattaattaccaaaaccctgtattgccatttatgttactgttaactaactcaaaacacatgattactgccaatgtgttttagcattaatggcatggctagtgtattgtattagtttcaatattgtgttgttctgcttggtttttaaatccgttcaactgatttagggtgtgtgaataaatagtttaatcggatgagagcttattatatacttgactgtgaactgtgaagcttgttgaattgaaataagctgaaagagcttattctaataagcttttccatcaagtttattgaaacaagttgttcaattgactgcaaaaccttttttttgtctttactaggattaataatggtatgggccaagtttattgttattgccgatgtgcataaatgttgacagggctgatatttggtcttttgggattacggcacttgagttggctcatggccatgcaccattttcaaaatatcctccaatgaaggtatttacatccagtggttgttcagagacaatgtctagacacatgttaacattggacccattgaagtttatgtgatataatttgtaataaaggaaaaagagagttcacttttatttcatgtataggttcttctaatgacaatacagaatgcccctcctggacttgatgatcgagataaaaagttctctaaggtattgctgttctttctggatgcactgttacacaagagtcatcattatgatacttatagttaattttactggttagttaattttactgttacttctaacattattcgtatgttatatgtggtatgaaatgggaaagtttgatattgggcacaattgaaatgaattgctcatagtggtttattttatttattatgatgagtactgtggttattatgtatgtatttgtagagtgagtgagttttgactgtgggctgctcctgcctctgccgttggtcttatcttttgctgaaacttgaaattgaatctctctcaagcttccttttttaaaaggttagggatcgaagcagaaggaagtaagtaagaagagatgggagtggatttgagacaagtggtggcaggtgtcctcaccctcacaatgtttgtcatgcttggaaatatgatccaaagagaccacactttgataattcacttcgagtaagcacaccctctttttcattttcatttgcatttgctagctcacaccagaaacaacaatataactaaattcatcttaagaatgaaaaccaaagcctttcttccacagagcttatagatcccttgtttacactgacaaactagaactaggagaagagaccataattgttttcaataataatgctttataattgaaccacattccaatatctagcttctttgatgcaaggtaaatataagcttaatgcatataaaaattgtttctaataattaaagtggaaaccatttgtctgatttgtgtttaccctgtgaaattatgtagctttcagcaagctgcagaagactgcagtaaggcaatatggcttgataagaaggtaagaaaatgggcacgcaatcgtggctatgggaatttactttctggtacctgatttctagttagtataatttttaaactccaataatctccaatcctaggaatgggatcttcctaatgttgtaccaatgtcttatatcctatcatttttttggtttgaaattctgatcacaccatcttacctcatagatatatgtcattcaaagatgccacttcaattttccaacattgttggtgaatataattctcctgaatatgaagactgcaggttttcgcaagtgtttctgccaggcgaacccccctgggaatcaaatttggagggtacatgccgaaaagcaaaggataaagctaaaatgagatacaatgagaaaaagaaaactcgaatgtgtgtggcgttggtatgtttagttttgattctaaaaaacatgtatgtgtttggttttgatgcttcgagtgcttgttgattagaagtctgcaatctgaatttgacttatccatggaattcatgtcatgttaatatttattctaatgcttataattggttactgtcttgctgacgttggtttagagctatcaatcctaagttcaaagatgaaaaaacacttgagtaacagtagaatagtcaactaaataaattaattaatcattgttgtcctaccctgaagtttaatttgtcattatcattcgacatcctcattgtattacatggttttcatggacacaaaatattgaaagctgggaagctgattgagaaagttctgagacttgtgtggagcaaattgtaagaggaacttgaatcttcatttttttttaacttcaattttctcttcttgtttttgaattagtgctgagacaattcatcaaggaattagcaagccacgaccattgagaactgagatagaacaaaaaaggagtgcgtattctttttcatagctatgtcatggttcttatatttttcttttatatattaaactagatataaatttggaggaaacttttttaatatttattaaattatataaaaaatttaattattttttatattattaaaaaataaaattagctcaaatgttcataatataaagcttatttattaataataaaataataaagataaataaatatggttactatttaatacaaatataaaattaattttgataatattgttctcgtgacgtcaaaaaacttttagcaatcagttcatggtgcaaaatgaatggggcaatactctattaatatgtgagcaagtttctttcgaagttttccacatttggagttgacaatcacgattccccttactgggactcatttccctattttattaatttttttttataaaaattaactcatacattattttattataatcatttttatggagatcattaatttaaaatcttataaaaaaatattgaaaaaatattctaacttcaattaaaaaatataaatttaataacacatattttattaattttacacctttgctgtgaaattaaaataaaaatgaaaatagtaacaaataacaaagaaattaattaatagtttaaatagtactctgctcagttatttctattgttacctattcttaaaccaatgatttgatgaaacgtattattttgttccatcttgtaattgcctatcatttttgctgtatattagaattatgtttatatgttgtcataaaaaaaatgttcttttcaaattctttagaatttatcatttcgtaagtattatgtttatatgttgtcataaaaaaatgtttatatgctcaatatttgctgtcagcatgacatgatgaaacatgttgcaacgatagtttagtttatccttttatatagctgcaactaagtgatttttaagcatgatattggctatttaatcattttttgtttatcgctatttcttgtggactaagagcaagtgtcttttatatatatatatatatatatatatatatatatatatatatatatatatatatatattatatgatgggtgaaaaaaataaaatatagtcatttaagacggtcgttaggaaggaaaactgtcttgttttgattttttttatataaaaaaagcatattctaagatggttattagagaaaaccgtcttagaaaaaacaaataatatttttttaaaaaaatattttctaagacggttattagtaagaatcgtcttagaatgtgacattttaagacgattttctgtaaaacagtctatgaatatcacattttaagacggttctatctaaaatcgtctttgtaacatgcagttcaaatttttttaataaccattttctaagacggttgttaggaaaaatcgttttagaatttgacattctaagacggttcttcctaacaaccgtcttagaatcctcaactttttttttttatttttaaaaagtcattctaagacggtttcggagaaaatcgacttaaaatttggattctaagacagttttgaaaaccgtcgtaaaaaatcaacactttctatgatgttaactacaaagacggttcaaaaatttgaatggcttaaagaaccatcttgcaagtagtgtactttgatccttaccattatggtcaagagcatttgaaggccatggaagagcacaagcaccgagctcttatccattttctcaagaggtgcaaaaagcctattgagctcatcttccattgcatggatcaagtggttgaagggttgagagactcgtacagtcccctagatccaatttcgatgcacgacacgccgaggttcctgcaactgatgattcttgatggctgttacatgttgtagattttgagagccaatgatagtgttccggatgattatgctgacaatgatcctgtctatggtaaacacgggaaattgtatatcatgcatatatcaaaagtaacatacttatgcttgagaatcagctacccattagggttcttcacacattgattgaggttgaaactgacacaacccaggtaattctcaaatttcttttgcacgttcaagacataaattaataaagtgaaactctaagctataagtgtttgtgctgaatttgtgttttattgtttactagaaggcgtactaattaaggtagcatcgagatggatgtatgaaacaggtcttgagcagcatgctagtctcttcttacagagaatgtgcatacaaacataggggctttagttgaaaccttcttgtaccagaaaaaacatacggaacttgacataatagtttatcataattgataatgccttagataaaagtgatcagcatcttttcattatttggtacagtagatgaggacaagattaattttctgcaaattttgaatagaaaatggcacggttgtaagtgatatagtttagttagatttttaaacaaaaattcatgaaattttgatttgattcgatttaaatataacattaaatttaaaataaatcatactaattttttatgattgatttgatttagtttcataattttattatctttttatctattatcataacttaacattatcaactaaatttacataattattatatattatttaatatttattattatttatcataataaaaattaatatttatcttaattatgaaacaaataaaaattaataaattatttaatatttattattatttatcataataaaaattaatataattataatatataatttatttgatttagtttgattttttataataagatttaaaaataaattaaattataaaatatacaatttttatattttatttttgtaatttttatttaaatgatttttatttttttattgatttggcagtttataaatagtttgatttaattttgaatattcctattataaaatgggatcaattaaatgataaatgtttcgtttttctaacactttccgagaaaaaactttcaaaaagaatggaaagactccgttttggtctgggtcgtgttgcttgcgttttaattaattttcactttgagaagacaagacatttacgcggttggttagattgtagaacctccaatgtcctacgcacataaaagctgttttgtgcacagcaccagagtcacaatcataataagagagaaaaacaaaacaactttcccctccctcttagatatcacctaaggtcatttccaataaatgatcatgtaagaaattttaagatgaagatatatttttctaggatttaattattagagattttctcaagatttttatattgaaggaggtatagtttttagaaaaattcttaagatttatattttaaaaaaaaatattattgtttagtatctcttctaagtcttaactaattattatggaaaagaaaaaaaaatataaaaatgaaaaaaaaactagataacacaaacaacataataatataatttaaaacaaataataaaaataaaataatatttatcatcatctgatttgagtggtcatctgaactttttcatcttcttttagaaaagagattatatatatatatatatatataattatgataaatgacataatattataggaagaaacatataataatttcttgccgcaacatccccaattttgattgactgatttcgtcttcattgattactcactcaactctcctttttagatttatcctttaataaattacttggccccattccaaccaaaatcaataaacttccacaattccacgttgatggtattctttggcttccttgttactattggatcttagtgataatcattggcgaatttaggattttttatttatgttcgcacattaatttggtggtggactcaggattttttttttaattcgctcaaaatatagttatttttataacaagatgcatataatagtttgatcattgttaacaaaccacctcaaagtaacaattcagaataacttgcacattaacacttcaatcagcagttagaatccacaagcttggtattatacaaaacgaaaccaaaaggatgactaattgcacattgatgagaatagaagagagagagagagagaaatcacctcgtagcgagccgcgacggaggacgggtcgggattcgaaggcggaagcggcggtgacagaggtgaggacgcgcaggtggtgacagaggtgaggacgcgcagtgacggaggcgaggacgctctgaaaataatgttgtacacaggggcgcggtgggcgatcgcgacgaggccacgatgggaagccggtgtcgatgcggcagacgacggtgtcggcgcgggatcggaggtggttgtggccgacggtggcagaggaggctgaagatgcatcgaccagtgcagagggctgagatgaggaaaaggtagcgtttttaaatttttttaccttttaacagatattataaaaaaaaaatccaaatgtttatgtccgcacttgcgaacataaacatacatgtaggtccgcccctaatgacaaccatctcatggggtcaattcggtaagtttctcatcttattctttgaaatatttctcatcaccttacttgagtggtcatctagacttttttttttcttttttctaagaaagggataatatatatatatatatatatatatatatatatatatatatgatagaaagaaaaatagagataaataatgagtgttaattttatgtttagcaaaataaaatattcaaaaatgattattctttcttttttgatgtccgttcaatataattgtgatccaaaaacagtaaccaaaacacaataaaataaaatgacccacgaaatgggaataagaaagctagcaaaccttggtcacgcttataattatggtccataccatacatactactactacatagtatttgactatttgtcattcgctttacaagtttctattaaagaattatcaaacatgttacttgtcatttaaaaataccaactagagaaatgaaaaaataaatgagaaaagtagtaacataaaaaattgaggaattaacttgatggtagactctttttttaacggatgatagactaaacttttaaaatattaatttaattataaaattattgaagaactaagatagtgacgaagaattcttaagagaatcagtgtatattattagattttccaagcaagctggatttcagcataatagtgcatgtatcctaatactgccttggaagaaaaaagatatcagcatgttttcagtatttggtacagtagatggagacaagtttgttttctgcaaattttcaataggaaatggcatgaaaggataaaagtgaaggtatttttttctaacacttcccgacaaaacaattttcaaagacagtaggaagactccgttctggtctctttatctatgggtcgtcttgcattgcatatataattaaatttctaattttttagaaaaataaaattagctctgattcggatatgtccaagacaaaaccggacacaatatacagtgcggacttgatcattttaagactcttgaaatgatccatatccatacaaaagggcatctcatcaactctcaacccttattactatagcgtcttggtcttggatgtgattgagtggtcattgttttttttaactttcttttgatgagctagttccgtttcaaagttgtgcctatagtatatagaaaaatagaaaaaaaaatgtcttacataaaatttgtcttgctacccaaactctcaaacattagaggtaccatattgaaatttgacatactattttaataaaaatgatgcgtcttgattcaagtaatttatttatctctttaatttattatttaataaaattgattatttattattaataatgagaattttttttatatataatacaaataatttttttttgcaaccattttttcctctttagtaccatacgtgagtatacaaaattaatgataacaagatataagtaggttagattggccaactcataccccaaatttaaacataatgattgtcctcaaacatttgaaagagtggaaatacttcacacttcaaacaaaattttattaatcactctaatttagattaacatgatctataaaaatctactcaacctcaacaaaagagattaagctaacataaagaaaaatgaagagaaaaaagagaactctataattgtagctaacatcctcattaattaacttgagaatcacagtcagtccttaattgtagctaacatcctcatttatgaaattaagggaccaccatcaaagaattgtatttagcatgaccacaaggttctcattcattatccttgagttggcgtggaatattttgtcattccttttaggaagtttcttggcatcttgatgaagggaagacttgacaatagctacacatagtttttgtcatttgttttagaaaaattcttgtattcaccttatagaagacaatctaaaaagttgtcaaacataatagttatcatttttataggaaattttagtgtcttaactcttaatgaaagcaaaattcaaaacactattaaacatataatacttgttttaggaaatttaggtcgacctaaatttgaaataggaaagtgacaaggtaaacgagaaaagtagtaacaaaaaagttgaaaaaattaatttgatgttagatataattataactaatttaggcataaaatcattggaaaactaaaatagtgactaataaatattttaagagattgattcgacaactaattttttttttaaaaaaaaaaaactaatgtaatctactaatatgtatatattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaataataactatattttatatagttaccttaattataatatatttgtttaagccgaattagtaaattgcaactaaatttttgcattaactatataaatttaatttaatttaacgcttttatgcttttagtttttctgaaattatttttatttctaatcctttcaaattatatttgttttattttttgtgtttgtaacattttagataatgttttcttttacagtttaaagtagtgttttaagtattttaaagattaaaaagaaaacaacataatttgtaagcactaaaattaaaaaaaatagttttgtaaggacgaaaaggaaaaacaataaattacaatgacaaaaaatatatttaaacaaaaaaaaataaagtaataacatgtataatttagaagaaataaaattaaatatttctctttgtgaaaataactttaattcttaaggagaattttcattttagtccctaaacttaaaagaaactaaaagtaaacacagaaaaaagagagttacgagattaaaagaaaaaaaatttatctatcgaattggattataatatgcatgttgtggatagcttgaacggttctagcaaaagcactactaaattgggtctcatttttggatatttgtagactagagcttagatatattcaaaatatcacaatatacatttttcatccgaagaagactattattaataaaaaaaatactataaatggagtaacaaaattatatttagaggatactataattaattttaacattgtcacgataataatcaattattagcaaaattataaatgtttagactttttaattgttggcaatataaaaatattatctaagaaacaaaattattttgataatgatttacaaatatattattatatcacaggcgaaggaagaaaaagcaaagaaagagttgaatggaaatgaaaggctttgaagcagcgtaggctataaatagaagtttgtgaattgaattggttgtatccaaaaatcgtctctagttttgttgttgagttgaaaagatgaatatgaataagaatgtttggtggcttctactcccatactttctcttccttcttcttctttttcttccttcttcttcttcttcttcatctttctgcaaccaccatgacagctctgccttgctacaactcaaatactcactcaacacttcaaatgacacttcaaatgattttccttccaaaacagaatcttggaaaaacggcacagattgttgtgagtgggatggggtcacgtgcgacatcatctcaggccacgtgattggtcttgaccttagcttaagtaatcttgaaggtcaactccatcccaacagcaccatcttcagcctaagacaccttcaacaactcaacctagccggcaatgatttttctggctcttcaatatattctggaattggtgatctcgtgaatctcatgcatctaaatttgtcatactctggattcactgctcacattccctccacaatttctcacttgtccaaattagtgtcacttgatctaggtagcctctactttataattcttgatcccaactacccgagaatgagaattgatccatacacttggaagaagctcattcaaaacgcaaccaatttaagagagcttaatttagatggcgtggacatgtcttgtatcggagagagctctttgtcattgctaaccaatctctcttcctctttgatctcccttagtcttaaagagaccaaattgcaggggaatctatcgagtgacatcctctgtttacccaatcttcaacatctaggtttggattttaataaagacctcggaggtgaacttccaaagtccaactggagtactccactaagggacttgagtctctctggtactgctttctcgggaaacattcctgattccattggccatttgaagtctcttaacacactacaattgtcccgatgcaattttgatggactggttccctcatcattgtttaatgtaactcaactctcctttttagatctatcatttaataaattagttggccccataccaagcgaaatcaataaacttcaaaaattgtggtctctagatttgtctgaaaacaagttaaatggaacaattccacgttggtgttattctttgccttccttgttaattttggatcttagcgacaaccacctcacagggtcaattggtgaattctcatcttattctttgatgctcttggcactctctaataacaaactgcaaggtaatttttgagtggtcatctggactttcatcaattttcaaagttcaaaaatctatcttacctcaacctttctcacaatagttttctctctattaactttgataataccgctgactacatcttacccaaccttaaacacttatatttatcttcctgtaatattaatactttccctaaattcttagcaccacttcagtatctggtcggactagatctttctcataacaacatttgtggaagcattccccagtggtttcatgagaagctcttgcactcctggaataacattcagcatattgacctcagtttcaacaagttgcaaggagaccttccaattccacccaatggaattgtgtactttttagtctcaaataatgagctgaccgggaacatttcttcagcaatgtgcaatgcaagctccctcaatatactcaacttggctcataacaacttgacaggccccattccacaatgtctgggaacatttccttctcttttggcattggatttgcaaaacaacaacctttacggcaacatacctgggaacttttctaagggaaatgcattgaagactataaagttgaatggcaaccaattggatggaccattaccacgttctttgacccactgcacaaatctgcaagttttggacctggcagacaataacatagaggatacatttccccattggctagaaagcctccaggagttacaggtactcagtttgcgatcaaataagtttcatggtgtcatcacttgtttcggtgaggagcatccatttcccaggctgagaatttttgatgtctcaaataacaattttagtgggcccttaccagcatcatacatcaagaactttcaaggaatgatgagtgtgaatgacagccaaactggtttgaaatatatgggtaacgacaattactataatgattcagtagtggttgtaatgaaaggtcgatccatggagctcgagaggatattaactattttcacaaccatggatttatcaaaaaatatgtttgaaggagaaattccgaaagtacttggagaattgcattctctcaaagggcttaacctttcgcacaatgcaatcactggtaccataccacaatcctttggtaatttaagaaatttggaatggttggacctctcgtggaaccagttgaaaggagagattcctgtggctttgatcaatttgaattttctggctgtgttgaacctttcacaaaaccagtttgagggtatgatacctacaggtggacagtttaacacatttggaaatgattcctatgctggaagtccaatgttatgtggattccctttgtcaaaatcctgcaataaggatgaagattggccaccacattcaacatttcaccatgaagaatcaggatttggctggaaagctgtagcagtgggctatgcatgtgggttgctatttggaatgcttttgggatataatgttttcatgactgggaaaccacaatggctcgcgagacttgttgaaggtatgcttaattaacgaagaatgaaaaggacaaatcataggggaaggaaatagtttacccttagtttaatatggttcttttgtgtgtgtctgtatgttttctgtaattttacttctgtcctttgtgtaacaaatctcatctctcttgagtgacgtatttcaagttgtttacaaataagaaaaaatgtgatgattgtagataccaaaatgagtggtcttcacatgtcatgctattggctcaaaaactttgattctaatctccaaaggtaaaaacttattagccagtagccaccacttgtatgtcaagcatgccatggtacaagctaagattaaaactggacttttaatttaaaaattggtttcccctacccctattacatactttctccaaacaactatccctaaccaactcagtccaattattgattaaattttgctgcatgatgatcgtagatgcgcccatggcaatgtgtccttttgggagttgccttgagtgaaaataaattaaacaaagtccccataacaatagccttctaataatgctctaaaagctggcacctttgcgaggctttcattaatttgaaagttaaaatggtaaatatttggaccaatcaaatgaaacaatattgaccatactagtattcacacagcaaatatgtggcaattgttcttgaaatcaactttattgtctgacagtattcggatcgatgtatttctgggattggtttgtatagggagatttttttatcacaaatattaattattagtattgttaatttttgtgtaggaaagatatagcttgtttacgtgttggatggattttttttatatgtatacataaattgtatttgttaggttatcccatatatcaatattctcttttttttaatgaatattctctcttttttgctgagaaaaaaatagtattcgaattttattatttagttttgcatttcaaaaatttataagatccaaaaaatgaaagcaaaaaaggttgaagttttaacggtaatccaaccaaattcgcacttacattttaatgtatatgaggatattaactacttaactaccttcacaactattgacttatgtttgtcacttcttctcaagatgaggttttagcagtaattcaaccaaatgtgtacatgcacaagtttagggtgcttgacttaaaaccttcttcaagtgtacctgttatagaaacatatattgaagttgacatactgcgcttcccataatattagctaaaagattctgattctcagctctaaagttaaaaatttagaagcaggagcttataacaagcaaggtataggtctggaattttatgaactcacgacgaaatattaaataaaattcttttgtatttaagtatttaaaaatagacatatatataatatcataacaaatgtacattttatttcactaaataaataatataattttaataaatcttaaaaaaatatcatattttttatttaagttgctcttatattattatctattattcaatttctatctcttaaaaaatttacatacacataaatttttatatataaggtaaacatgacaaataatgaacaaatggagagacatgtttaactatctttatccaagttctttatgaaaatattaattttaatttttttattttataattttaatttttttgtgtttcttcaatatgttgatatatcaatgaattaaaaattcaatcaatatgaagttatgattgtaaaatgttagaaaaattaattaaaagagtgacactttttaataatattaacatattttaatttaaataaaaattgaagcgtaaaataaacaacaactttaatttattgatatgaatcttttaagggtgacgatgacattgtgatgtaatgagcgaaaactgggaggagcaagagcctgtacttgtacaaacaaagcgccagtcccggaaaaacattccattgcctagcaaacatagcggttcattatcatcttgaatggatcttctcatgagcattaatgaccacaggtattggagttttgaggtaaatgaacaaatgagtgaatttgaatttgatgaaaatcacatgtataatgcacagcataaaactagagcattagatagtttgaatttcactattggtggcactgctgtatgatacccgaactctactctcttttttctgtatataaatcaaaatctagagaatttttaaatgaagtatataacagaaatattcaggtcatattttgacagtctgatgcgtgaaacaagttttctagcatagtgcagtttgagatctgatggttgataatgttttaactaaaaaaaaattacttttaaaaactccctctcttttcataagttgagataattttataagtcgttttttttttaaggaaaaaaaaaatccttcccttttttttgtttaccaaagtggatggattaaaaaactgtggaccacgtgtttttgcagtcactttccgttatatcaaacagagcttaaaaataatctatttaatgaatattcactctgtgttctggaaaaaaaaattataatattctaatcttattattcagttttgcattttaaaaatttataagatccaaatttgcacttacattttaatgaaagaggatatcaatacatgtgataacccaacaaatacaatctacgtataaattaagtgattaactaactgagaattttattactcgatctcctaataacaaatgagggagaagctgatcgtttcattccgagaagatatgaaaatgagtgtcatcccatattattggctcaaagacttcaattcttatctccaaagataaaatcttatgagtcagcacttgtatacagaccacagacgttatacatatgacgggtcaagcatgccatagtgattgtaacttataagagcagttattaaaactggaaactggacttcgattttaaaaattggtttctcctacccatattacacgctttctccaaacaactatccctatcaaagtcagaccaattcttgattaattttgctgcatggtgatcgtagatgcgcccaagccaatgtgtcaccataacatcaaagtcaccataacaatggcctggtaattttctaaaggctgccacgtttcatatttgaaagttgaaacgatattgatagatatttggaacaaaaaaagaaacaatattgatcatactaatacacagcaatgaattgatcttgaaaataaaaacatagtcctacttctgaaatttatataccctagcaatgtccaaatattgaaaacaaatttattcactgatactatattcagatcctattattcagttttgcattttaaaaaatattggaaacctattaaaaatttatatcaaaagataaaacaaataaaaagcaatatactcttgtgtaagatttttattattattggctaaatttgatgtgaattctagtataaaatttgagtgatgggatttacataaaattcactcagtgattaaagatttatcaaaaggactttctagcatttcacaactgccaaagagtttacagactccattttagcgtctcaaatccatttgttaaacgtaatttttcctttaaaaaaaatggctcacgtgaaacgtgagtcacactctctccactttaattgaacattcttatcatctatattttggacgtgaatttcaaacattatttctgtaaattaaaacgtctcaaactctcatttttctttatctgtatttgtatgtttaaacattttatcactattttaaaattgaattttaatagttcttataaaaacagattatcaatagttaaacatatcatatcataatttaaattattcattataaatttaaaatataatttatatattaaaaaaattactgaaacaatttttataagctgaatttcaacaatatttatttatgatgattttaatgatataaaaataaatttaatatgattctttcgcgtgcgatgcgtgttgttttatgtaattttaacttttgcctttttggaagaaatctcatctatcctgagtgatatatttcaagtgttttgcaaataaaaagaaaaaaatgtgatgaatacttttgttttaatttcaagtaactaattttccattaagttatttagggaaacgcgcgtgtataatcatccaggaaaatatgtacattgaactttcaatcgacccactattggcattatattaggaacatatatttactgttttctggaagaatttaggctaacacaattaaatgtacaattgtatcattgtattttcagatgtagttagttcatgatgaatgttgttcaggcatcaaagctactgagaaaagtagaaaaagaaaattgaaaattgaaagtaacataagaataaaaataatttaatttttaatacaaggtaattagctccttaaggttactttctagcatcattccaaagtcttccttttcttttggctgcatcttagctctctgcttcatactcttgtgggttgctatttggaatggtcttgggctgtaatgtattattcactggaaaaccctaatggattgcgagacttgttgaaggtgtgctatatgtcagagtgaattgaaaaaaacaaacaacagaatccatgcaaattttcaaggaacgaattagtttaatatggttctgtattatgtgggtttatcaatatatatgcatttatttaccgtaagttgtctgagttgtatcctgcaaaggcattgaggaaagtaaaattcacgcgttcaagcttcaatccacacagaatcagcatttgtttaggaacaaaatcatacagttttcttgaagaacttatattttcgcaattgaaagtacaagagaatcagtgtattttagattttccaagcaagctggatttcttgaagaagtgatcagcataatactgtatcctaatcctgccttggaagaaacaagatatcagcatgttttgactatttggtacagtaggatggagacaagtttgttttctgcaaattttcaatagaaaatggcatgaaaggataaagtgaaggtatttttttctaacacttcccgacaaaacaactttcaaagacagtaggaagactccgttctggtctctttatctatgggtcgtcttgcattgcatatataagtttctaattaaaatttgatttaactttcgattttaaatcataaactatataaaacaaagatggttttttataaaatatatttaaaaataattgtaatctttgtttatctcaattaaattttgaaatttgacatatactattttaataaaaatgacgtgtcttgattcaagtaatttatttatctctttaatttattatttaataaaattgattattcattattaataatgagaaaatgaataatttttatttatatataatacaaatatgttttttttcaatcattttttcctctgtagtatcatacatgagtatacaaaattaatgataacaatgatataagcatacaaaattaatgatatataacaatgatataagtaggttagatggaccaactcataccccaaagttaaacaaaatgattgtaatcaaacatttgaaagaatggaaatccttcacactttaaacaaaattttattaatcactctaatttagattaacatgatctatagaaatctactcaacctcaacaaaagagactaaagtaacataaagaaaattgaagagaaaaaagagaactgtataaatccttaaagagacatggcttactacattcagactcaaactcacactaattaacttgagaattcagtccttaattacagctaacattctcatttatgatattaagggaccaccatcaaagaattgcatttagcatgaccacaaggttctcattcattatccttgagttggtgtagaatattttgtcattccttttaggaagtttcttggcatcttgatcaagggaagactcgacaatagctagacatagtttttgtcatttgttttagaaaacttcttgtatattcaccttatagaagacaatctaaatagttgtcaaacataataattatcatttttataggaaattgtaagtgtcttaactcttaatgaaagaaacattcaaaacactgttaaacataatacttgtcatttctcttaggaaatttttactcgttttaacaggttaagacttaaatttgaaataggaaagtgacaaggtaaaagagaaaagtagtaacaaaaaagttgaaaaaattaatttgatgtcttaactaatttaggcatacaatcattggaaaactgaaatagtgactatgaaattttttaagagattgaatcgacaactaattttgttttttaaaaaaaaattaatctaatatatatatatatatatatatatgtatgtatattgtgtgtgagagaaatttgtaatacgggggtgataaacgtaacagctccatattcaatcctttctaaataataaatttaataataaatataattaatatcgttttatttttattgattaataataactatcttttaaatacttaccttaattataatatatttgtttcagccaaattagtaaaataatattttgcaactaaattttggcaataactatataaatttaatttaatttttattttatatattagttttattttgatttagcaactaatttttaaaaaagtttaaatatatttttagtctttataatttaaagcttttatgcttttagtttttgtaaaattatttgtatttccaatcctttcaatttatatttgtttattttttgtgttcgtaacattttagataattttttttacagtttaaaaaactattttatgtattttaaagattaaaaataaaacaaatttaatttataaatattaaaattaaaataatagttttgtaaggacgaaaaggaaaaacaataaattacaatgacaaaaaatataattgaacaaaaaaactaaattaatacatgcataatttagaagaaataaaattaaaaaaattataaatgtttagactttttaattgttggcaatataaataaattatctaagaaacaaaattattttgatatgaaacacgggcgaaggaagaaaaagcaaagaaagagttgaatagaaatgaaagcctttgaggcagcgtaggctataaatagaagtttgtgaattgaaatggttgtatcaaaatcctctataattatgttgttgagttgaaacgatgaatatgaataacaatgtttggtggcttcgactcgcatactttctcttccttcttcttcttctttttcttccttcttcttcctctttctgcaacgaccatgacagctctgccttgctacttttcaaaaactcgcttgctctcaacactacacatgattatttctttttctgcaacccccttgacacctctgccttcccacaactcggagactcactcaacacttcaaatgattttccttccaaaacagaatcttggaaaaacggcacagattgttgtgagtgggatggggtcacgtgcgacatcatctcaggccacgtgattggtcttgaccttagctgcagtaatcttcaaggtcaactccatcccaacagcaccatcttcagcctaagacaccttcaacgactcaacctagcctttaatcagttttctggctcttcaatatattctgaatttggtgatctggtgaatctcatgcatctaaatttgtcatactctggattcactgctcacattccctccacaatctctcacttgtccaaattactgtcacttgatctcggtagcctctacttgaaaattcttgataccaattacccgagaatgagacttgatccatacacttggagcaaactcattcaaaacgcaactaatttaagagtgcttaatttagatggcgtggacatgtcttgtatcggagagagctctttgtcattgctaaccaatctctcttcctctttgatctcccttagtctctctgacaccaaattgcaagggaatctgtccagtgacatcctctgtttacccaatcttcaaaaactatctttgttttataataaagacctcggaggtgaacttccaaagtccaactggagtactccactaaggtacttggatctctcttacactgctctctcgggaaacattcccgattccattggccatttgaagtctcttgacacactacagctgtggggttgcaattttgatggactgcttccctcatcattgtttattctaactcaactcttctatttagatttaagcgataataaattagagggaccaattccatccgaaatcaataaactttcaaaattgcagattctatatttgtctgataacaagttaaatggaacaattccacgttggtgttattctttgccttccttgttagagttggatcttagcgacaaccacctcacggggtcaattggtgaattctcatcttattctttggaagacttgtcactctctaataacaaactgcaaggtaatttgagtggtcatctggactttcatcatttttcaaagttaaaaaaactatctagcctcgatctttctcacaatagttttctctctattaactttgatagtaccgctgactacatcttacccaaccttaaattcttatatttatcttcctgtaatattaatagtttccctaaattcttagcaccacttcaaaatctggcccgactagatctttctcataacaacattcgtggaagcattccccagtggtttcatgagaagctcttgcactcctggaataacattcagcatattgacctcagtttcaacaatttgcaaggagatctcccaattccacccaatgccattcgatactttttagtctcaaataatgagctgaccgggaacattccttcagcaatgtgcaatgcaagctccctctatatactcaacttcgctcataacaacttgacaggccccattccacaatgtctgggaacatttccttttctttgggcattggatttgcaaaagaacaacctttgcggcaacatacctgggaacttttctaagggaaatgaactggagactataaagttgaatggcaaccaattggaaggaccattaccaaggtctttggcccaatgcaaaaatctggaagttttggacctggcagacaataccatagaggatacatttccccattggctagaaagcctccagcagttacgggtactcagtttgcgatcaaataagtttcatggtgtcatcacttgtttcggtgccaagcatccatttcccaggctgagaatttttgatgtctcaaataacagttttagtgggcccttgccagcatcatacatcaagaactttcagggaatggtgagtgtgaatgacaaccaaactggtttgacatatatgggtaaccacaatttctataatgattcagtagtggttgtaatgaaaggtcaatacgtggagctcaagaggatattaactattttcacaaccattgatttatcaaataatatgtttgaaggagaacttccgaaagtcattggagaattgcattctctcatagggcttaacctttcgcacaatgcaatcactggtaccattccacgatcctttggtaatttaagaaatttggaatggttggacctttcatggaaccagttaacaggagagattcctgtggcttttaccaatttgaattttctggctgtgttgaaactttcacaaaaccaccttgagggaatcatacctacaggtggacaatttaacacatttgaaaatgattcctatgttggaaatccaatgctatgtggatcccctttgtcaaaatcttgcaatgaggatgaagaaaggccaccacattcaacatttcaccatgaagaatcaggatttggctggaaacctgtagcagtgggatatgcatgtgggtttctatttggaatgcttttgggatataatgttttcatgactgggaaaccacaatggctagcgagacttgttgaaggtgtgcttaattaattaagagtgaaaagcacaaatcataggggaagaaaatagtttactcttagtttattatggttcttttgtgtgtctgtatgttttctgtaattttaacttctgtgtgtggaagaaatatcgtctctggtgagtgatctatttcaagttgtttccaaataagaaaaaaaatgtgatgagtgctttggattcaatttcaagcaattaattttccgtaaattgacattatattaggaatatatatacaattctctggaagaattctggctaacccaattaaatgtacaattgtatcattgtattttcagatatagttagttcatgatgaatgctgttcagcatcaaagctactgtgaaaagaagtagaaaaccatcctttcggtagttttagaattcactgcggatgaaggttctgtgggtcttctgtctttttctttactaacagcactacagaaaagtccattagtttaagatcggtatgtttttgcttagtgaaaggactttatgccaaaactccaaccagaaagagtaggatttcttatttgccaaaacacaaggctatccttgaaacaaagtatttaatagtaaaagacggagaatttgcatacaaatggattgtcgcttgagttaaaaccttctttcaactctctgttctacaaacagatattgaagttgataattgatcctgatacagcctctggaaagactgatccatatgcattacaaaatttctagacaaaggcaccagagggtaagcatgttcttgaaactaagggttgaggtaacattagaatcagataatgtacctcaattgttttttaaaattaaaataaaaaaataaacataatatcagagacaaatgttagtgatcagaggatgagagggatactgatatgtgcctagcacatgatgctttccaagattaattagattgttaaatgcatcattttatatgataaagagcttccttttgatatgaatgtaacttatgtgcttcaatgaggtattttggtctagattgatgtttagcaggtgaaatagcagagaattatgcagagaagaaagaaagcctatgtacaatcgggggtacataggctagttctgcagccacgccccaggcgtgggaacccacgctccaagcgtgggaaggtgcttccttatgctgatttctctggacagccacgccccaggcgtgagattccacgccccaagcgtgggaatctgcagagtctgcataatgagggcaaaatgaagatttcacaagctaccttataaatacttcaacctcagcattgaagacacacttctgaagcacgaaaatcacttggaaaagggttagagaaagcttggaagcctttgctagggtttgggtgtgaggggaagagggttcttccctcttcccttcctcttcttccttgtacatatctacatcatgcttctttttgttgtaccaaggccagccctgtgaggtttggttagtttctcttgtaattagggcaaatactctatgtaactttcatttggaatggattgaatgtgattattcctttatgctatgctattttactgcactttgtcttaatcttttcatctctttcctagacttagctaacctaggtgagagcttagagctagggttcacaatagacatattggggctctagtcttggaaccaagtgtggtgacttgctaacatcacctagacatagggatgggtgcttgcaatcttatagtgcatcgcttaatgcttaacctaataaaatgtcactaagagattagggcatgaaaaagggttaaagggttaatgtcagctgagacatcaaggcttaactattaatgaatgaggatgcatgattgagtaggtagtatagatgaatgttgtaatcaatccatgtaagaatgttaggagtgttgaatgtgggttccctagttaccttaggtacgtttagtacaaccactacctatcttgtatataatgctttaagtttatgtttatgcttatatttagctttaattcacttcgtacacacacatctattcctctccattattgcttttgtcatccaaccttgagatacgatttatgatttaattgaccaaacaatcctcgtgagaacgatatcttatttatcactttattacttgtacgaccggtatacttgccgagttcgcgacagatacatatcacaggcataggccaagtaatggaacaaatctcaagaggttgcacattgattgattaaaatacagagaaggtatatggtgctcttatttatacaatctattaagcgattaacatgtaattaaccatgatgaattaagtgattaactaactctaagtagaattttactactctcctaataacacacgtgggagacgataatcttttcattcctagcgagaagatatcaaaatgagtgatcatcccatattattggctcaaagactttgatgcttatctccaaagataaaaacttaaaagtggacttttaatttaaaaattggtttcacctacccctgttattacatactttctccaaacaaaaatccctaaccaactcagtccaattatttattaattttgccgaatgatgatggtagatgtgcccaggccactgtgtccctttgggaggttccttaagcgaaaacaaataaaccaaagtcaccataacaatgtgttaggaaaaaatataggaaacctattaaaaattcatatcaaaagataaaataaataaaaagtaatactaacaatataatcttgtttaacatttttttatcattgactaaatttgatgtgaattctattacaaaatttgagtgatgggatttactgtaaattaaaacatctcaaactgtcatttttctttatatgtatttgtatgtttaaacatcttaataatttgtctcttttcatctaccatcttttatcactattttaaatttgaatttcaatagttcttacttcttataaaaataaattatcaatagttaaaaataatattatatcataatttaaattattcattataaatttaaaatataatttatatattgaaaatattgctgacacactttttattagctgaattttaaaagtatttatttatgatggattttaatgatataaaaaaaaaatatgattctttcgtgcgatgcgtcttgttttctgaaattttaacttttgtcttttgtggaagaaatctcacctctcctgactgatctatttcaaataatcaaattgtttgcaaatacgaagaaaaaaaatgtgaagaatgcttttgttttaatttcaagtaactaattttccgtaaattatctagggtaacctgcataagcatcaaggaaaatttgcacattgaaccttcaatcgacacacaattggaattatattaggaacatatgtactgttttctggaagaattaggctaacagaattaaatgtacaattgtatcattgtattttcagatgtaattagttcatgatgaatgttgttcaggaatcaaagctactgagaaaagaaaaaaagaaaattgaaaatgaaagtaacataagaataaaaataattttaatttttaatacaagctggtaattagctccttaaggttactttctagcatcattccaaagtcttccttttcttttggctgcatcttatttctctgcttcatactcttgtgggttgctatttggaatgctcttgggctgtaatgtattatttttgaaaatccaatcgatgaacacccctatccttcatgatgtcaaatttacacgacctaaaactctcaaatatacaagtttcataaacaaaagtttcagaacattttgggggtagcaaatagttgtaaagccatatgctaggcctatgcagtaaaaaaaaaatttaaagaaatagggtgctaccgcactgcaacactgttgggtatgctatggaaataatttctttattagaatcacacatcacaaaatggttttggtatcgacattaaactatgcatgtacaatattaaataagaacttgaaaaaaaaataccaaatgtacaactatattaaagaaaatgtaattattaatatattattactaaaacacctggaaggaacaaagtagaaaaccctacatcacatatattgatccaaaatcctaactctttccatggctgtgaaaattcaaattagtttttgtttacctacattctccattccaacttcaaaacatgttggataaggttccgtttaatgttgactcaaatccctaggcatagaaaaagggaaagtttggtgggccaaatcccgaggatttttgcagccactttccgttatatcaaacagagcttaaaaacaatctatttcaaggacaggtaaaaaggatcctcatcatcccattatttgtcgagtaacaatattaaactgttcatgctaagatacaatttttcaagcgatccatgttcgtgtgaacactcaaaaaatcttgaaaacaattgaaaacacaaattcggtggttgtagggatgatttgcataaaatcatcccgcacttcaaattagacgcgcaaataaccaaatccattgaatagtttttagtacatgtcattgtcaaataattaaacagcctattcccatagcaataatattaaactacctgtacgtcatagcaacaatattaaactacctattcgtcatatttattatccttcacttctaggcatgcaagcaaccaaactcaataaatgtttactacatacagtatcattgacaagtatgtttggtaaatcatttcagtaacttatatctagcttataatctagtttgactaaaaataacaaattatttatcatattaattatttaattttaaaaagtccgagcaactaaaatttagtttaagttaactaattttctttaaaaccatctgcggttttgatttgcaagaaattggtgtaagattgaaatttagtaggtgaatatcgactaacagtccaaacataccattaatactcttctttttcaatttgtaaacaaaggaacttatataaaccacaattcactcatttaagagcatttccggcgttgtttagtctaggtttcttaaagtcaaggaaatgtgcttaacttgatttatggttggaacaaatgacctagtgttgcttatccaagcacgtttcgttgctttaaaactttttaattaaaaaaaaaatcaatttttcaagcttacaatcaacagacaaaggacggaagtttatataaaaacaccaaaccaattctaaaacagaatcaaacacaattaaattaagacccaaaaattaaaaaaatacaatcaattttagatctcacaactataaactctgagcaaataaaggtttatggttgcaagttctaaatttaattgtatttttttaataattgtgactatttgttcgaaggagttgaggaaataaaaattcgcactttcaaatcccaggttattcttattatttttgtaatatcacaattcacaaggacgtagcaatgctttggaggctactacactatttttttttttcctttcttctctagataacgcgtcaagggaaaactcttaacaaaattgctaactgctctattctcaacctacaaacaaatattccttttcttttcaaataattgcaaagaaaatagagtaatacgaaaagctcatattacaaatgagcaccctaagggtagtcatcgaataatttttttttctccacaactactttggtactgatatgagcctttcaattaagaaggcttatatattttctccaatggcaagtagttattggatgttttccatgtcactgagcaaaatggaaacaagtaaggaataccaaaatttatcttagtggttgttgttgaatctattgaatcactaactataaagccggtattggatcattcataaatattcaagtgtgttaaaaatttcatattgattagtgatataatgaaaatgatgtatataagtgagggacaaccctcatcttgtaagttaatttttggagttaaattaagctcaaactcaaaacaaagataacatcatatcataacttcaattcattattaggtcacttgtcatattattcacacatcaaatccaatagtgagaagcatcaagggttgtataataagagcttataaagctaagttaagttttgagattgagttaaatcataaaacaaattctaagactcttagaacttgtttgatttccttctcattttttatttatgtatttattgttttaaaagttttttctaaaacaattcttcactaatcaatcaatttatcatataaaatctattaagttttgaaaactgttttcaaaacaagtgttttaaaaactaaaatacagaaacaacttggagatatttcccttttcacttctcaatggcagtagatagagagacaagaatagcattggagagaagcttcttagttgaagaaagagcacaagcttcctgtcctgaaaattcatttatttgttaatcattttataagtttatcatacggcatgagcttaaagtgtggaacagtgtggataatatgatttttcatttattcgtgtcaaggaaggatcgatgcttctggcttcatataagccacggtattacagtgaagctgtttatcaataaaaaggatgctttggacggtctaggggtctactacagagcaggtgaataaagaaaatgataaacagaacaagacaaaactgatttcatccatcaaacaagttctattttataggttttgaaaacgaaaatcaaacacactcttattctctgcacttgtatgatatcgaactcaagttgttctcgttgaaaagagtagtccaaaccaaaaaaaaccatcatacttataactatcaattagcttttctgctattttaagcaaacatagcttaaatgcatgtcatctaaaaatggttgttaaaaaaatgaataatgcaatcatatcatcattaatatgtgataagaaacattttttaaaatttatgagtattaaaaaagaataaataatgcatgtactaacaatgtaaagtttttaatgttgtccccaatcacaagtagtcctgtataataaatttattgacttttagaagtcataccaaccaagaatgatgtatgataggttgaaaatgtaaaaaaaattacacttaataataaatacatattaaactcataaaaatttggaacctaaaatctttggttaagttggaataattccacaaaagttaatccacttgtttgatgatatttaggagttgtatcttaaacgctcctttaaaactaaaagtttttttctttattccatattgataaattcaagatatggagaaagaagctaaggcgtacagcttattttttaaaaatactccggttaggttttttttaagtagttacttttccctccttttcttttatgaaaaatacatttcttaatttttaagagtttttttttctaaatgtgtttgacttaacttctctttttaagaagaaaaacttatatatataaaaaaaaagatcaaacactacctcagtcaaatttacatgactaaaaatatattttctcatgcttttttcatgatatgattgctacacatttatatgatatctctgcaacggaaatttaacataagaacaacatttgactgattttatgcaaaagcacttgaccaatatctcaaagggccgaagattagcgtgattaaaatgattcacagaagaaaaaaaactatggacagtaaaattgttacaagatcttacatatttcagaacagatggcttttagatataacaggaatttcacagctcatagccgatgggaatagccagaacctccacatttcttgcagaatatcaatcctataaagtgaaacacacgcataaacagaaagaaccatatagaggcctaaagtaagccattcatgaacgtggggggagaaagcgtactgattttcaatcacacaccaacggtaaacaaattcctataggtggtaaataaaaaggaattgaatccaaagtaaaagaatgcaaaatataagcaatcataataatttgttttatgcatatgagaacagaaagagatacctgaacccttgcaaactttacagttcattaaccccatttcttgcttcatcttgccatcgttgcaaaaaacacattttgtcccacctgcttgtcagcaatgttattcaaaaaatagtaacttcttcaacaatactaacaagttgctcctttacttcatatacaatgtaaaacacaaatcaatttaagaaaggcagacttgcagaaatcccattggttaaagtacaaagagggtcacaagaataataaaagcattgagagcgaaaatggcagtaaaaagtagaattctcataatcatcactaaaataggtactagactttcgttctccagtccagatgacctattgtcatacaatatatctccatttacagggtgatataattattgaaaggagaaagcataggtggaaaggggtaaggagagcaaaaactgggatactaggaagcagaatcttaatccaaaaacaattggttgagcagttgaagctttatatataatgtcatacattatagtggtagaaacccaataagacctgtcatcaagtcaaattcgaacatcatatgttatccacaaacttatacaggtgaccctgagtcagcatcttcttatgcaagattttcttcttttaatttcagtagaaaataaacaaaattcataaagcatttgctactgatcactccccttatgggaatacaaattcaggcatgttgttgctgggaatattctttgaaacttgaaccaagtgcccctaatgtctgcttggttgaataggtggaaaataggagcctagcatgtggagattttaacatgaaaaacactacacatttgattgatatgacaaaaacatgaagaggagggaaactgtttgtattttccaccttctcactatccacatgctcaatcaagcagaccccaagtatcctcagtcaaagcagtcattaatcccccttttaacgacagttatccaattcaagtcagtgtttgtactttatacacataaatagtgatatcctcgctcctaatattttaaaatgttcctcatattcttggcataaagccttagtaatttccataaaaaatcaacataaagcatagcacatcaatgtttaagcgcaaatgcagaaagataattaccgttgccagcacaacgttcacaaggcaccggatcaccctgcaaaatcccatcactcatcaggaaacacaagcatcaactttgacccacaatgtcatgtcagaaagtagcatacacacttccgtaagcaaaagtggaagcaattatgcctgtgaatcctatagcacgtttctgaatgaggtaaacgggttgttgcattcaccactaatccaccgccacgcctctcaaaaaattgtttttttattttatcaaaaccaaccaaaaaatcaaacaaaagttatatacattcactaaatttctcttattccacatcatttttcatcctatctctctatctttctctacactttccatcacattacttattacttctatccctttgtctctctacttttatttattcttcctatctctcttcttccaccccaaaatggggtgaatgcttacaaatttaataacgcaaaataattagcaaaattggacccacactatgactaaaaagaacacattttcgaaagcatacataacaaaatacataaatgcacgtgggttttatagtaaaacagtaagtgttacattacatctataacaaagaaggaaaataaaaaacatatttttaagaaaagtaagagaatcccagaagtaaaggagcaaaaatgaagaaccttaaggccaaggaagagagaaagagcaatggcggccaaaacactaacagtgacgataagtgtttgcgcgcgtgtcgaaatagaaagtggtggcgaagccgttaaagagcaaaatggggtcgatgatcgccagcagccttggcttgttggtagctttgcgttgtagtttggaggggaattggggaatagagcgagaacgtgtggaagagcatggagaaagatgaacagaggctttagaagaagatagaggaagaggatgaagagtgtagtaacgaagagtgatcgttgataaaaaaaaaaaaaaaaaaaaaaaaaaaaaaaaaaaaaaannnnnnnnnngtgaagctaagctaagcgtcgccattttttcagtcgctactcttcgaatacatcagaaacttccgccacttttgtttttcttttgttcggcttgatgcttacatgaatgaatagtcatacattttaaatagtgacgccaagtggaagttgtttgaatacttacacctacaattttattgtctatatttgatttgaattaaattatatatgataaatgatacatataatctaaaattaaaaatacatttttaatgtaaaaaaaattatattgttaatcaattaatttgttttaataattatatcaattaaaattttattttttattataaaaaattataaatttagttgatataatttttataaaattaataaatttatcatatataataatttgtaattaaataagataaagctataaaaatgcatagcagcatgtcttctctaattttatacacggattatctcaatttcatgtactctttttttttggctatcaaatcaggttttgccttaaatttgtcttttttacagagtttaattttcatatattaaaatttaaaattatcaactaataaaaaataatctcatacatagcttttaatttttaaactaattataaaattaaaaaacggctgttgaatgtaaatggaggttgagattaacaatccaaacaagcgctgcatgtgtaaaattaacttgcttctctataatgatagtgcttgaccatggccagaagttttttccccacaatgtttggacatttcttttatattatggttttgaaatttataccgatgggttctatcaggaattagacacatacctgaactaatactttttaaatattgatacatttttaaaccgattcaaaatcgataaatcagtcaaaaattaataaattagatatttttaaaccgattcaaaattgataaatcggtcaaaaattaataaaattaggtgaattaactagttttgctctacatcgttttggtttaaataaataaaattgctgaatttagatattatgttgaactaaatttgtaatatgttatgacatataacacttttaaataaattttattttttattattattaatttatacatattatattagtttttatttatattactaagatgttataataaagtattaaaatatatattattaaaatttatttgacttcaacttaatttcaattaaatcattaattcttgaattaatgtgttcatggattcaaacgatgaatccaattctcacaacattggtttatatcctaattaattgtcatctcgtgtgtctcgtcttgctttccatcttgtgaaagaaaaaccagtgatgcagcatggagtggtacttgctaagagcaataagtgttgtgccacgcaattctaaaaacatcgtaaaagaaacacctatgatgggtctgtctagaagcattttctggcatctcatctgctattagtagtaatacttttaatacataaattaataaagtgaaactcaaattttaacaggagaaaaatgccaaaaacaactaatgaacgtgtatatgttttctccaattataattttacataccccaccaaccaaaattccaaaactctaaatataagatgtttggttattgaatgagaaacaagatgaaagattgaacaataataaataaatgaaaacttaaatatgtttaagaaatttaataaataatttaattttattctgaacttttaataaaataatttgttattttgagtcatataaaagtgtttgttttaaatttttgtcatcaattaagtgataatatatcatttcataaattgatattttttaacattataaacaattgtaaatgtttaaaaacctaaaacaaaatttgatgatttgtcatagaaaattttaaacatatttaaaccataaatcaacaattatctgattgttgtgagctagcatatcagacaaatgttccacgccgcgattggttgatgagagaagcaattgtgaggggtaagcctgattttggatggattccactctccccaccacatcatcatatgtataaagccttgacctataaataaatggacatagtgtatgatgaggatgcaaatctaactatctaagcataacaatactgtaatatattaaattaaatctaatgatttgctccaataaataacacaatgcttacatctccaaacagaagtctgaaatttcactgatcacgttttttttcttctgaaatttcatccaatgatttctccaaatgatcatagtgtccctgtgcaagaaacgaaaattctacagaagcagaccaggctaaataatttttgccattcagtttctctgaagtgatggttggtatctcataaatagagaaaaaagaaccttctgatttctgatcatctcctaatgccattttctataataaaaataaaacgacttataacgttgagcaagcaacaaaatcaatacggcactccacaactaaatcccggacgaaaagttacactattagagacccagaatacacacacaaaaaacccacaacaagcatatatataaacgctgctccactctcacttaaatacactcttatcatcaaatagtagtaatgcttttaaattttaatattgactagatgattaagaagttgtaaatgaatatcaaaaattaatttaaaaaagagataagttaaactttagttgatattaaaatgataagatggtttagaatttgaagtataaaatataaaatatatatttaaaattgatttttgatattcaattatatgttgttaaattgttaattggatgtttaaatttaaaagcatacaagagtataatgctaggtgagtgagatacatcactttatgagagtgaaagaagagtattcaaataaataaataaaagtaaataatgcgagggagagtgggaagaataaaagcctcaaaaagaaaaagaaaaaaacttaacatccgtttgatttgtatgagtttaagggatttgtataaatttaagggacaggacagctcaatacttattttctatttaattttaagaagactttcaggacaacacaaaataagtgggacaacaaaaatgtaaaattttgctacccactaatacaattttttgtctcaaataaaagagatataaaaaataaaaatactcattatcttttttctctctctccactcaacttacggaatatcattcatattattttcagtgacaggattcaaaaaatgcaatactcacatataaattagtgagacaaaccttatattacaacttaattattttttaactaaatttaaattattgagataaattataactacattttcatgttatattaagaaaaataaaaatttagtggggtgattgcccccgtcttcttatgtgtagattcatcctgcttatcttatcttatatatacagttatcatctttttcaatatgaggatttttataaggttattaatataacaagtgcacaacgtttactttatgttcttaatgtattatatgtgatttatgtgaaagaaattttaaatctaatgatgatttttaaaaaaatattattcagctgaaagttataaaataatataattactatcaaagttaagttgatataatttgacctcttctcataaataaatatatatatatatatattaatttgatatatactatattatatattattttataataataattgtagcaatataattattaaaataattaatgataaaaaagagtataatagtatatttgacattcttttacttgttaattattcaccaaacaaaacaataagttgtcaagtaacttaaacaatcattttgctttgttctctttgtattataaatttaatagtttcaaacggattaataaatgaacatgtacagtagaaactggtgcactttaaaagtatttaatgtcaacgacgtagtggcgaatgcatgagaaaatgttgtacatattaaacttttgtaatttgttgttaataaaatcatttttaacccacaactttaattaacataaaatacagattcagttaacgtgaaatataaggaaaattagaaacaatacaatataatattaaaattaatgttgctatggctaagtataaaaattttcaaaactttaattagtcatcacggcaggcccgcaattacttatataaatatattcacagtcaatccagatctagcgtgatgcataatttcatcccgtgcaattttcatgtaagacggcacaataatgttaaaaaatttagcgtgagtgataagaaatgtttgtattcgtgacaaattttataaaatggtcactctccacaacgggaacaataacggtgatgcttataacttctgcaccaaagttcataaagtgagtaaagtaaaattataacatataggaatcgtactaacttctgaccttaaaagttcaaaatgtgagtgagctaaacttgggatatgtttagcctagcttatttttagcttaacttttacagccaaacactaaaaccataaatatttgtaacagatggtgggagtcacataattgcccccggtctcaagaagctctaggaaataatttgatgcacgcaacttcaagtatttttttctctgtttctttatattcgttattagcatttaacccatgatatacacgaacataagcttaatgataaataataaaatgtcttacataaaatttgtcttgctctccaaagtctcaaacattagaggtaccatataaactctcttattattatgtatagattacgctgaaatgtacttgagagtgttttaaacgctcaaaacaacaaattcttctttattaggttaagctaatattttttcttgttcaaaaataatatctggcctttcaaaatgttagttgacatttggcatctagtaagaaagagattaaaaaaaaaaagagaaaatataattatgatcagtgacataatgtgatagaaagaaaaataaagacaaataatgagtgttagttttgtgtttagcaaaatagaatattcaaaaatggttgttctttctttttggtgtccgttcaattgtgatccaaagcagtaagcaaaaccccataaaatgacctaaaaatgggaataggaaaactagtgtgataacaattaacatatataatttcgaagaaataaatttaaatatttctcttcgtaaaagtaaaaataaaatagaagacaattttgtcatagttatgtttaataatcaatttacaactcttgttgtaattaatctatttttttattataaattctagttcttttattaaatgaaaatgtttttatactcataaaaaaatgagtgtgtttgtatgaattattctcttttacattaagttacatacgtagcttattttgtatatctaactttttcatttaaatatttttatatttttatcccttttaaatgcaaatacttaaaactaattagttctaattaaaatttcatttaacttttgattttaaatcataaactatataaaacaaagatgtttttcatcaaataaattttaaactaattgtaatcgttcatctcaattaaattttgatatttgacatattattttaataaaaaaattacgtgccttgattcaggtaatttatttatctctttaatttattatgtaataaaattgattgtttattattattaataatgggaacatttattatttttatatttatatattacaagtatgtattttttgcaaccaggttttcctcttagtaccatatatgagtacataaaattactgataacaatgaaataagtaggatagattggccaactcataccccaaagttaaccaaaatgtttgtcctcaaacatttgaaagagtaaaaatacttcaagacttcaaacaaaattttattaatttaatcactctaattaaaggttaattaattaattaacatgatctataaaaatccactcaacctcaacaaaagggatttagctaaacataaagaaaactaaagtggaaaaaaagaactctatagatctttaaagagacatgagttactaccttcaacttaaactcaactaacttgaaaatcaaagttcttaattacatgcaactaccatcctcatttgtgataacaaggtaccaccatcaaaaaattgaactactacacagcatgacccaaaaggttctcactcgttatccttgagctggtgtggaatattttgtcattcatcttagaaagtttcttgccatcttgatgaagggaagattcgacgatagttaaacacaataatttatcgtttgttttagaaatattctaatactcacaccttgtagaagacaatctaaaaagttgtcaaatataagtcaattgccatttatgatagaaaatatttatccgtttttgacaagatcaagaatagaaaagtgacaaagtaaatgagaaaagtaatagcaataatgtttaagaaataaacttgatgatagattaaattagaattaatttagtcatagaatcattggagaactaaaataatcacgaagaaatttttgattaattttgctgcacgatgattgtcgatgagcccaggcaatgtgttccaatgggagatttcttaagtgaaaatatataaataataatcataacaatacaaaatttatatattaaatattttaaaatttataaatttgtacaattcgaaaaaaattaatttttttttactaatgatatgtttacaaaattaattaaacaaaataaatgttttaatggttcatcaccttactttggaataaaaggtcatgagtttaaatcctactaagaacctttttactttttactttatttaacctctatctagggagaacaaaatagtggatttgaaattaaagggagatcaatattacaatttggtctaaatgtttttatatttttatatatcccttttaaatactaatacttaaaactgactaattataattaaaatttgatttaactttctatcttaaatcataaactatataaaacaaagatgtttttttataaaatatatttaaaaattattgtaatctttgttcatctcaattaaattttgaaatttgacatatacttttaataaaaatgacgtgtcttgattcaataatttatttatctcttcaatttattatttaataaaattgattatttattattaataatgagaaaatttataatttttatttatatatactacaattatgtattttttgcaaccatttttttcctttttagtatcatacatgagtatacaaaattaatgataacaatgaaatagtaggttagattggccaactcataccccaacaaagttaaaccaaatgattgtgctcaaacatttgaaagagtggaaatacttcacactttgaacaaacttttgtgctaattagatgattgttttagaagtttcaccttaacctaatggagatttagccattttttgctgtttctcgaaactctcacaaactacaagtgatcatatattcagtttttcttgtaacaacatacaaactttttgcaaattgaaaattatacaaatttctgtgaatcaatagatttacaagcagatagtagtatctgttatatatagtccgacatttctaagaagcttgaactttctaagtgataaattttcctataaaaagacaattaatcagtaaaatagttaacctataaaaagtgttattacataaattataattaccgatgttataaaaacaagaacttagaattaatgcgactttctttaaaaaaaaacatagaatgcaatattaataccttttcattaacttaaaccattaataattaaacaaataactttatataatatataaaaataccaaaatatcttaatttattaatactctatttttatatgtaaaaaaaaaataactaagctccaccactgcttgggaaatttaagaaatttggaattgttggacctctcatggaaccagttgacgggtgagattcctatgactttgacaaatttgaattttctcgttgtctttaaccttttacaaatgtgtggacagtttaataatagatttggaaatggttcctatgcttgaaatccataatccaatgaggatgaagaatggcaaccacattcaacacttgatcatgaagaatcaggatttgggtggaaatccgttgtagtggaatgtaatgtattcttctcgggaaaaaacccaatggcttgcaagacttgttgaaggtgtgctatctgtcagagtgaaaagagcaaacaacagaattagtgtgtttgtgggtgttgatcagtatgtatttttttttttttttttgtaattttaacttctctgtttgtggaaagaaatctcatcccaatatcattaggtgatgtatttcaaattgttgtgcaaataagataattagagatcaatcgcttttgtttataaattaagttcaatttatttgccacgcacaaattgtctaagatttgacctgcaaagacattgaggaaaattcaagcgttcaaccttcaatcatcacaagatcagcattttattaggaacaaacttgtacagttttcttgaaaaacatacattttttacacaattgtgtttagctttttcaaacaagctgaatttgtgttttattgtttactagaaggcgtactaattaaggtagcatcgagatggatgaaacaggtcttgagcagcatgctagtctcttcttacagagaatgtgcatatatacaaacataggggctttagttgaaaccttcttgtaccagaaaaacatacggaacttgacataatagtttatcataattgataatgccttagataaaagtgatcagcatcttttcattatttggtacagtagatgaggacaagattaattttctgcaaatttaatttgaatagaaaatggcagggttttacgtaatacagtttagttagattttagaaagaaaaaaatcatgaaattttgatttgattcgatttaaatataccattaaatttaaaataaatcatactaattttttatgatttgatttgatttagtttcataattttattattttttatctattattataatttaaaattatcaattaaacttacataattattatatatgttataaatttttaaaaatgaattttatttttattatattttatttaacattaaaaattattatcttcacttttatttagaattaataaaaaataatattatcaactctttttatagcatagtagtaatttatacataatgatatttaatattatattttaacaatattaatacatcatttttaagatatgagaaagtaaaatatatatcttacttataataaattatttaatatttattattatttatcataataaaaattaatataattataatatataattgatttgatttagtttgattttttataataagatttaaaaatacattaaattataaaaaatatacaattttttatatttttatttttgtaatttttttctttaaatgattttgattttttttattgatttgacagtttataaatagtttgatttaattttgaatattcctattataaaatggcatcaattacaagataaatgtttggtttttctaacactttcagagaaaaaactttcaaattaagagaatgggaagactccgttttggtctgggtcgtgttgcatgtgttttaattaattttcactttgagaagacaagacatttacgccaacaccaacaacagaataatataatttaaaacaaataataaaaataaaataatatttatcatcatttgatttgagtggtcatctggactttttcttcttcttttagaaaagagataatatgtataattatgatagatgacataatattatagaaagaaacatataataatttcttgtcgcaacatctccaattttgattgactgattccggattactcactcaactatccttttaagatttatcatttaataaattagttggcctcattccaacaaaaatcaataaacttccacaattgtgagccctactttagactttagtctgataaaatgttaaatgaaacaattccacgttgatggtattctttgccttccttgttacgattgaatcttagtgacaaccacctcatggggtcatttcagtaagtttctcatcttattctttgaaatatttctcatcacctgacttgagtggtcatatggacttttttttctttttctaagaaagagattatatatatatatatatatataattatgataggtaacataatatgatagaaagaaaaatagagataaataatgagtgttaattttgtgtttagcaaaataaaatattcaaaaatgatttttttttctattttgatgtccgttcaatataattatgatccaaaaacagtaagcaaaacacaataaaataaaatgacccaagaaatgggaataagaaagcgagctacccttggtcacgcttataattatggtccatacatattattactaatagaacttgtttgaataagactagtaatatttatgagaatttttttatagaaaaaaatttatattgttagaaaaaaaaatcaaaaacacttataatttatatctaaacagagacaaatttaaataaataatataaattaaataaataattcgaaaaatggtgcagtttgaaaaatatttcaaaatctagggctgtgtaacacgtccaatttaggcgtgtttaagctggttgcgacacgtgtcatgtatgcgccgtgtcgaacgaactttgaacggtcatagcttttgataggaatgtctgatggaggcatatgatatgtcaaaacgtttgaaattcagaggagaagtcctagcaacaactttccaaaggggagttggcccaatattttttccaaaaaaggtctataagtgcctcaaaattaggatttaagagtacgtcagccaaaaattttcaaatagtctaattatttaattagttaatttaatgttattttctattttttaattacttctcttaatttcgagcattttgacatatcgtacgtctccatcggatatttttataaaaaattatgaccgtttgaagtttatacgctcaaaattcactcgaactcaaaatttatgcatgcgttacaaatcaatttgaaatgtatcaccatttttatttgcaaatcaaacaacaataataccatgttaatgtatgaaagttttgtctcacattaagatgacgacattttttttctttgctctcttatttatttcttttaccaatattttaatccaattttgttagatttgttgttttcgttttggacctctttttaaaaatattttttagaaaaaatgttttctaaattttaagtaaataatttttactctaaatgaaaataaaaaaaaatacttaaatgaagctccaccttctccatttttccttatcacattctctatttttttcctatctatttaagaactaaatttatatattaaggtttaggttagacagaggagataataggttccgcaagtaggactaccatagttttagatttcctctacatattaccagaaaatgagaaataagaaatgagaggttttttttatacacattctttttttttgtcaaataatccaaataaggtaatatttttttggtatatctatttaccgaaattatactataaatttttaaacaatttcagtttaaaaaattaaaaaattacaatattgtggtcgcaacactaatttcaaaaattgaaaaaaattataacgtaaattaaaaaattgatttaaaagtcgtatgctaaattagtggccacaaacacttagcaaccgaattagagacggcattttttgtctcaaatatttagtgaccgaattagtgacgaaagttattttatttttttccgcatgtttgacaaccccaaattttgaattattttacaaacagctccttttttccaattatttatttaaatttgccccaaacagactatgactatttatcattcgctttacaagtttctattaaagaatcatcaaacatgttacttgtcattaaaaaatacaaactagagaaataaaaaaaattggagaactaagatagtgatcaagaaatcttaagagactaaatcttaagagactaaacttatatacaaacatgagaaaagtagtaaataaaaaattgaggaattaacttgacaatagacttttttttcggatgagagactaaacttttaaaaatattaatttaattataaaattattggagaactaagatagtgatcaagaaatcttaagagataatttgttaactattttttgaaaaacaaaaagaaaactagagttataacataacattttgaagaaataaatttaaatatttctcttcgtaaaagaaaaaaaaatagaagaaaattttagtaacctttaattatttgttatagttatgtttaataatgaatttacaactcttgttgtaattaatctgtttttgcattataattcgagttctacttttaaatgagagtatttttacgaattattctcttttacattaagttacgtagctttttttatttagtatctaacttttttatttgaatatttttatcattttatctcttttcaatacaaatacttcaatctaattaattctaatttaaattagatttaaattttaattttaaataataaactatataaaataaaataaaattaaaattattgtaatattttttgtctcaattaaattttgaaacttaacatgttatattaataaatatattatgtatttatttgagtaatttatttatctatttaatttattatttaacaaaattaatgacgagaatatttattatttttatttatatatattacaattatgtattttttgcaaccattttttcctcttagtaccatacatgagtaaaaaaaatcatgataacaatgaaataagtaggttagattggccaactcataccccaaagttaaacaaattctttgtcctcatacatttaaaagagtggcaaaacttcaaaaataagtagaaagattctaatacttacaccttgtagaagataatctaaaaagttaaacatatgtcaattgtcattcattataaaaaaaaatacctgtctttgacaagatcaataatagaaagtgacaacttaaatgaaacaagtaataacatataaattttaagaaactaacttgatggtagattaaattataattaatttagtcatcaaatcattggagaactaaaatagtgatgaagaatttttttaagagattgatttgacaaataatttttcaaaaaaaataaatatatttttagtctttataatttagtgtttttatgcatttagtttttgtagaaaaattatttttaacccttccaaattttctttgttttattttagataatatttgttttcacaagcactattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaaaaataaaaaataaaaattttgtaaggatgaaaagaaaaaaaacaataaattggaaggataaaaaatgtatttaaacaaaaaaaataatgtaataacatgtataattttgaataaataaaattaaatatttctctttgtataaataaaattaaatatttctctttgtataaataatttagttctttaagaggaattttcatttgttttagtcccctaaattaaaagaaactaaaagtaaagacagaaaagagagttaagagaataaataaaatgatcgaattggattataataagcatgttgtggatagcttaaatggttctaacaaaagcactattaaattggatctcattttggatatttgtagactagagcttagatatattcaaaatatcacagtatacgtgtttcatccgaaagagactataataaaccaaaaacactataaatggagtaaaaaaaaaaattacatttagaggaaactataattaatttaaacattgtcacgataatcaaataggagcaaaattataaatgtttagactttttaattgttggcaatataaaaatattatctaagtaacaaaattattttgataatgatttccaaatatattattatatcacaggcgaaggaagaaaaagcaaagaaagagttgaatcgaaatgaaaggctttgaagcagcgtaggctataaatagaagtttgtgaattgaattggttctatccaaaaatcgtctctagttatgttgttgagttgaaagtatgaatataaataagaatgtttggtgggttctactcccatactttctcttccttcttcttcttctttttcttccttgttcttcttcctctttctgcaaccaccatgacacctctgccttgctacaactcaaatactcactcaaaacttcaaatgattttccttccaaaacagaatcttggaacaacggcacagattgttgtgagtgggatggggtcacgtgcgacatcatctcaggccacgtgattggtcttgaccttagcttaagtaatcttgaaggtcaactccatcccaacagcaccatcttcagcctaagacaccttcaacgactcaacctatcctataatcatttttttggtgacattccctccacaatctctcacctgcctaaattattgtcacttgatctaggtaacttcgtcttgatagatgatgatgatgattccaactacccgagaatgagactagatccatacacttggaagaagctcattcaaaacgcaactaatttaagagagcttaatttagatggcgtggacatgtcttgtatcggagagagctctttgtcattgctaaccaatctctcttcctctttgatttcccttagtcttagatacacaaaattgcaagggaatctgtcgagtgacatcctctgttttcccaatcttcaacatctagctttgtatgaaaataaagacctcagaggtgaacttccaaagtcaaactggagtactccactaaggtacttggatctctcttttactgctttctcgggaaacattccctattccattggccatttgaagtctctttacagactatatctgtggcgttgcaattttgatggactgcttccctcatcactgtttaatctaactcaactctccgttttagatttaagagagaataaattagagggaccaattccaagcgaaatcaataaactttcaaatttaagggttctatggttgtctgataacaagttaaatggaacaattccacgttggtgttattctttgccttccttgttaaatttggatcttagcgacaaccacctcacggggtcaataggtgaattctcatcttattctttggaacgcttgtcactctctaataacaaactgcaaggtaatttgagtggtcatctggactttcatcaattttcaaagtttaaaaatctatctagcctcgatctttctcacaatagttttctctctattaactttgatagtaccgctgactacatcttacccaaccttcgagccttatatttatcttcctgtaatattaatactttccctaaattcttagcaccacttcaaaatctgttcgcactagatctttctcataacaacattcgtggaagcattccccagtggcttcatgagaagctcttgcactcctggaataacatttattatattgacctcagtttcaacaagttgcaaggagatcttccaattccactgggtggaattggatacttttcagtctcaaataatgagctgaccgggaacattccttcagcaatgtgcaatgcaagctacctccagatactcaacttggctcataacaacttgacaggccagattccgtcatgcctgggaacatttctttttcttttggcattggatttgcaaaagaacaacctttacggcaacatacctgggaacttttcttattacggttgtgtattgaagactataaagttgagtggcaaccaattggatggaccattaccacggtctttaacccactgcaaatatctggaagttttggacctggcagacaataacatagaggatacatttccccattggctagaaagcctccaaaagttacaggtactcagtttgcgatcaaataagtttcatggtgtcatcacttgtttcggtgccaagcatccatttcccaggctgagaatttttgatgtctcaaataatagttttagtgggcccttgccagaatcatacatcaataactttcaaggaatggtgagtgtgaatgacagccaaactggttcgattggtttggaaaacctgggtattacccgcggtttgtataatgattctgtagttgttgtactgaaaggtcaatacatggagctggtgaggatattttttgctttcacgaccattgatttatcaaataatatgtttgaaggagaacttccaaaagtcattggagaattgaattctctcatagggcttaacctttcgcacaatgcaatcactggtaccattccaaaatccttgggttatttgaggaatttggaatggttggacgtatcgtgcaaccggttgacaggggcgattcctatggctttgaaaaatttgaattttctggctgtgttgaacctttcacaaaaccagtttgagggtatgatacctacaggtggacagtttaacacatttggaaatgattcctatgctggaaatccaatgctatgtggaatccctttgtcaaaatcctgcaataaggatgaagattggccaccacattcaacatttcaccatgaagaatcaggatttggctggaaagctgtagcagtgggatatgcatgtgggttgctatttggaatgcttttgggatataatgttttcatgactgggaaaccacaatggctcgcaagacttgttgaaggtatgcttaattaatgaagagtgaaaaggacaaatcataggggaaggaaacagtttacccatagtttaatatggttcttttgtgagtgcctgtatgttttctgtagttttaacttctgtcctttgtgtaacaaatctcatgtcgtgatgtatttcaagttatttacaaataaaaaaaaaatgtgatgatggtaaatatcaaaatgagtggtcttcacatgtgatgttattagctcaaaaactttgattctaatctccaaagataaaaacttactagccaatagccaccacttgtatgtcaagcatgccatagtacgagctaagattaaaactgaacttttaatttaaaatttggtttcccctaacccccattacatactttctccaaacaactatccctaaccaactcagtccaattattaatttttgcagcatgatgatcgtagatgcgcccaggccaatgtgtccccttgggaggttccttgagtgaaaataaataaaacaaagtcaccataacaatagccttctaatgctctaaaagctggcacctttgggaggctttcattaatttggaagttaaaacgatattggtaaatatttggactaataaaatgaaacaattattgatcatactagtattcacacagcaaatatgtagcaattgttcttgaaatcaactttattgtctgacacaatattcggatccatgtatttctgggattggtttgtatagggtggttttttttatcaatatatattaattattagtattgttaatttttgtgtagaaaagttatagcttgttaatttattggatgaattgtttttatatgtatacataaattgtatttgttgggttatccgatgtgtcgatattgtctttcttgaatgaatattctttcttgttttgctaggaaaataaatagtattagaatcttattatttagttttgcatatttcaacaatttataagatccaaaaaatgaaagcataaaagggtgaagttttaacggtaatccaaccaaattcgcacttacattttaatgtatatgaggatattaactaaatacttaactaccttcacaactattgacttatgtttgtcacttcttctcaagatgaggttttagcagtaattcaaccaaatgtgtaaacaagtttagggtgcttgacttaaaaccttcttcaagtgtacctgttatagaaacatatattgaagttgacatactgctcttcccataatattagctaaaagattctgattctcagctctaaagttaaaaatttagaagcaggagcttataacaaataagggacaagatggagagatatgtttgactatctttatccacgtccatataaaaggtaaaaatgatttaaaatagatcatattatattttttaatccaatttactttaaattttatattttttaaaaatattaattaaatttatgatttaatttattttttatatttggtccttcaaaaagaaaattcgagatctacatcattatcatctatcattgacaaaatataatttcatattaaagtttacatatattttgttctttatgaaaatactaattttagttttatttattttataattttttttttgtgtttcttcaatatgttgatatatcaatgaattaaaaattcaatcaatatgaatctatgattgtaaaatattagaaaaattaattaaaagagtgtaactttttaataggcaaaaaaacgtaaataatacttttttaataagaaattacgaatttggggttgtttgaaacatattacaaatatgaaacagttagtcacatccaaattaggcgtgacttgtcacgtccaatttgggcgtgttatcccctgagtcacatccaaattgggcatgtttcaccctgtgacgacacgtgtcgcacattcgtgaaacggtgtgtatataaattttgaaaggtcataactttttataggaatgtctgattgaggcgtagtttgtgtaaaaacgctcaaaattgagacgagaagccctaggcaaatcactaatgggatttggtcaacttttttttccaaaaaatgcctctaagtacctcaaaattaggatttaatcttcaatcatccaaaaatttccttgttttctattttttaattatttaattagttaatttaatgctattatttatttattttaattacttctcttaatttcgagcgttttgacatatcgtacaccttgatcggacatttctatcaaaagttaaacaattcgaatgacatatcgtacgccgttgtaacttttttcgatattttaaatttttatatggttttgtttaatattttttgtattttttatataataaccccatttattccaaaacacattcattcctaacttttccgcactcatttcacactttaccactcgttccactcatcccaaagtgcattcaccacacaataattggaattctagcaccccattaattccaaagcgcacttggagcggtaaaacattgcagaactctagaaatagaagtggaactgcgtgagacaaagtgaatcaaattgcattgcgcttacctaaagagataaagatggaattagcgaccgaatcagagacgaaattagcgacaaatttagtcatatatttccaaacagccccaaatttataattttttattaaaaagtattatttacgtttttttaccctttttaataacattgacacattttaatttaaataaaaattgaagcctaaaacaaataacaactttaatttatttataaaaattattataaaactataaagttaaattaaattttgaggcccttttaatcatagactcagtgtcatcatcgcacctccagaggaccctcaggtcagccttaaagcattgataatttggtatacatggactgaaaggaatagcttcaattcattcatgactaaggcctaaggcctaagttaaccaagtgggtctataagcatcaatgcatcatcatcattggtgtcatctacggaaaacaatactgaacaattaatgtaggaattcgtgctaattctcttgaatggcacttctcatgagcattaaaggccaccggtattggagttttgaggtaaatgaccaaatgagtgaattggaattttatgaaaatctcatgtataaagcacagcataaaaccagagcattagatagcttgaagtgcactattcaggtcaaattttttctttatgtaaatcaaaatctagagaatttttcaatgaagtatataacagaaatattcaggtcaaattttgactgtctgatccgtgaaacaagttttctagcatagtgcagtttgagatctgatggttgataattttttaactaaaagaaacattacttttaaaaactccctctcttttcataagttgagataattttataagttgttttttttaaaggaaaaaaaatccttctctttttttgtttaccaaagtggatcgattgaaaaactgtggaccacgtgtttttgcagtcactttccgttatatcaaacagagcttaaaaacaatctatttcaaggacaggtaaaaaggatcctcatcatcccattatttgtcgagtaacaatattaaactgctcatgctaattgctaagatacaatttttcaagcgatccatgctcgtgtgaacactcaaaaaatcttgaaaacaattgaaaacacaaattcggtatttgtagggatgatttgcataaaatcatcccgcacttcaaattagacgcgcaaataaccaaatccattgaatagtttttagtaaatgccattgtcaaataattaaacagcctattcccatagcaataatattaaactacctatacgtcatagcaataatatttttgggtagcaagaacaataattagtttatgaaaagaaagaaagaccaaagtgcggttggttccccctcctccttgggtgcatccctgtggcctagccaccgaggtagggttggtgattcttgaacccgtgcttttgattctccttcgttttcttctttggtctcttcttctccaagagaacaccttcctgttgctgttctctttttgggtttttctgagtgcaggttaccccttcaccaattgaggttgacccatgttacgttgtgttttgtgataggggaaaaccaaaaataatggttcgaagaagggtaggatgacccaacatgcttgttcaaaggaagcctcggttgggaaagttgatggagctgtatctaagggtgcggctgaaagttccattaagagtgcccgccaggtgttcgaggatttgcctgaaggaatgtccaatgtagaatcatcacaaaatgtatccatcactttgggcaatgaagatacggaatcagtttcgcttgaggagtgtgaatcttcagtgggaaatggtgaagacccacttcctttgtcggatgaaacaacaagagtggaggaaacccataagccagctacaaacaaaaccaaagcttcctggtcgagtctgtttaaagacaacaggaaggctgctgagggttttgaattggaagcccaacctgattgtgtagaaccatgcatatctcttgatgaggaggacattagccctttgcaagaggcttgcgggtttagtgccattgggtatgttgccgggaggttccccggaaagaaggctctaatggaggaatgcaacaagtggggagtcaagttccaatattccgttcacccaagtggctggctcattttcaaattcgagcatgagaagagcttaaaccaagtcatatctgggggaccttatttcatttttcagaggcctttgcttctaaagaaaatgccagaattatttgactttggtgaggaggaacttagccgtattccagtgtgggtcaagcttcacaatctgccactccagctctggaataaaaggaccttgagcaagatcctgtcacccgtgggcacccccataagaacagaccaagttactgcatctttaggctcttatgcctatgctcgggctttggttgagattgatgcttccaaacctttggtccacaatgttcaagtcaacttgcctaaaggaaaggttcttgtgcagcacattgattatgagtcaaaaccctcattctgctcccactgcaatatgattggtcatgccaaccaaaattgcaaaagaaaggaagacaaatctgtgtcagctaccctccctgagaatccagtattgaatgttgctgagccaacaattagagatgcagaggcagaagtggagccagccacttctccagaccatgattgtgttgaagtttcgaagaacttaggtgatgataaagctgggtcgaacccacacatagaaccagaggccaatacaactactaatccagcacaagcccatgttgatgaggagggctttatcaagaggaaaagtcgaaatagaggaaaaaagggcagaagtccctcggtggggcttgaccggggaaaggagaaagctagcaatatgcagaggaggaatataattaatgctatctctgttgggaaggcctcttcccatcaaaaaccatgattatctcctcctggaacataaggggtttcaacatgccccgtaagcatatagctatgcttaacatgttgaaggccaaggatgttgatgttatggcaatccttgaggcaaaattagattctcagtttattgacaagctgaaaaagtccagatttgcaaactggaatgtggcggacaatctcagcacccacccagctgggcgcattcttattctctggaagggggatcgagtctctttagaggttttggacaccaaccctcaagccatgcattgcaagttgggctgtaaaatttcaggggagattttctggatttcttttgtctatggcttgcactctattggagctaggagagatctttggaactctctgcatctctttgagcctaatccagctgggccatggttaattatgggggacttcaacagtgtgctgaaccctaatgaccgcttcaatggatctcctatcactgcttatgagatgcaagacttctccaattgctgttctgaattggggattcatgagctgaattgtaatgggcaattctacacctggacaaacgggagaatttggagcaagattgacagagtattatgtaatcttgactggaccaccaaattccagcactccttttccttagtgctgaatatggaatctgtttcagatcatgcagcgttggtggtgaatactgctccccatcttgctcgaggtagatctgcgtttaaattcagtaatgctttggctgaccatccagacttcttggactgtgtctcatttcattgggctaagcaagtggcaggccataaaatgtatcaagtttgtaagaagctgaaagtcatgaagcatgacttgaaaggtttgtttaaaagggactttagcactatttcggcccgtgtagaagaggctgaaaaagcctaccataatcagctccttcagctctcttctaacccgaatagtagctctcttaggaggagtgtggcagagctgaggaatgctgcttgtaatctcagaattgctgaatcaagatctcttgcacagctctccaagcacaagtaccttctcaaggcagatagaagctccaagttctttcactccctgattaataagaagaggaactccagattcattgcagccatttacaatgaggagaatcagctcacttcttctatggccgagataggaagcgaattcgtgacccattttcaatctctgctgggttctcagcctaacaccctgcctccttccagagatgtgtgcctgaggggtcctttagttactgaggcatgggctgctgatctgttaaagcctgtgaccagaactgaagtttgggacattgtttcttgtatggatgataataaatcccccgggccggatgggtacaacgccctgttttttaagaaagcctggcagattataggagaggacatctttggtgcagttgcggagttcttctcttcgggcaaaatgttgaagcaaattaatcatgcttttattgctttgatacccaagtgtcagaatgccaacagagttaatttgtatagacctatatcttgctgtaatatcatctacaaaattatagctaagattctggcaaaccgcttggtcccggttctggaacatatcattgatgcttcccaggcagcgtttgtaaagcacaggaatatggctgataatgtattcttggtgcaggaacttattaggaagtatgctaggaagagggtttcccctagatgcatgctcaaagttgatttacataaagcttacgactccgtctcttgggatttcttgaattggatgttattaaatctcggctttcccatccaattctgcaattggattattgagtgtgtttccactacctcatacagcatttcccttaatggaacaattcatgggcactttaaaggtcgtagggggctccgtcaaggtgatcctctctcgccatacttatttgtgttatgcatggagtatttatcgagggatttaaagaatctggacagcaacagcgggtataagttccatccttcgtgctcagcccagaagatcactcatctggcttttgcggatgatatcatgttgtttgctaggggagaccttgactctgttgcagcaattttctccaagctagataatttctgcaatatctcgggccttaagattagtgctggaaaatcagaaatcttctcagccggggtggacagccttttgctagctgatttgcactctttgacaggcttcgggtctggttcatttccggtgagatatttaggcattcccctaatggcttctaggctgaatgtgtgccattattctcctctcctgaaccagattgggggcattattctcagctggaaccgcaaatccatttcgtatgcaggaagattggagcttatccggtcggtcatctttggtattgtaaatttctggttaggaatgttccctttgcccatctcagtcattgataggatcaatgctttctgtagaaatttcttgtggggtaaaccggagcttggaaagaagaaaccgctggtggcttggaagactgtatgtacccctaaagaggagggcggcttggggcttcactgtcttaagagctggaaccatgcccttctagcccgctccatgtgggactttaccaacaagaaagactccttgtgggtaagatgggtgcaccatttctatttcaaagagagttctgtttggacgtttcagccagccaaatcagattcgacactcatcaaacggttgtgttctattcgtgatttgattgtttccaaggagggtagcaactcccaagctgtagtggtgttcaactcttggatcaaagagaacagatttgtggcagccatggcttatgactatttccgcagcccaggaaacaaagtccactggtacaaggtggtgtggaatccggggatccccccaaaggaatccttttttctctggctggctgctaatggcaagctccttactctggatcgagctccttttttgcaaaaagggacgatttgccagctctgtaagagggaggcagaatcccatgaccatctttttttcaggtgtagaatgactatgcggatttggaatgacattcgggactggaccagatttcccaggaactacatctcgctgaaggcagccattaatggcatcattcaccagcgggcaacatcgggcaatgccgggaaggttcggtgcttggctcttgctacatcagtttattgtatatggatgtgtagaaattgcattttgtttgatgaccatgtatttaatcatacagacttgcttgaaaaaatcagatttcgtgtacttaggatgacacatctgttgcacttgtattagcaaatttgctcgtttagattagctagtctgtaggttctagcttctgcttatttgcttcttttggcaagtgcatcagtttttatcttttctgtttaaccagggtatgccctgtgtattttgtaagtatctttggaatatattcatttacatattttccaaaaaaaaaaaaaaaataatattaaactacctattcgtcatagcaataatattaaactacctattcgtcatatttattatccctcacttctaggcatgcaagcaaccaaactcaataaatgttaactacgtacagtatcattgtcaagtatgtttggtaaatcatttcagtaacttatatctagcttataatctagtttgaataaaaataacaaattatttatcatattaattatttaattttaaaaagtccgagcaactaaaatttagtttaagttaaactaattttctttaaaaccatctgcggttttgatttgcaagaatttggtgtaagattgaaatttagtaggtgaatatcggctaacagtccaaacatatcattaatactcttctttttcaatttgtaaacaaaggaacttatataaaccacaattcactcatttaagagcagttccggcgttgtttagtctaggtttcttaaagtcaaggaattgtgcttaatttgatttatggttggaacaaatgacctagtgttgcttatccaagcacctttcgttgctttaaaactttttaattaaaaaaaaaatcaatttttcaagcttacaatcaacagacaaaggagggaagtttatataaaaacaccaaaccaattctagaacagaatcaaacacaattgaactaagacccaaatattaaaaagaaaaaatacaatcaaatttagatttcacaactataaactctgagcagataaaggtttatggttgcaagttctaaatttaattgtatttttttaataattgtgactatttgttagaaggagttgagcaaataaaaagtcgcattttcaaatcccaagttattcttatttatttttgtaatatcgcaattcacaaggacgtagcaatgcgttggaggctgctacacatttttttttttttcctttcttctctgtcaagggaaaactcctaacaaaattggctaattgctctattctcaacctacaaacaaatcttccttttcttttcaaataattgcaaagaaaatagagtaatacaaacagctcattatgttgataaatttagatattatgttggattacatttgttatatgttattacttataacacttctaaatgaaatttaatttttattattattaatttatgcacattatattattttttatttaatattactaagatattaaaataaagtattaaaattgatttgacttcaaatcaatctcaattaaattatcaattcttgaattaatgtcttcatcaccgattcaatgatgaatccaattctcacaacattggtttatatccaaattagttacattgtcatctcgtgcatctcgtcttgctttccaccttgtgaaagaaaagccagggcagcatgtaatggtacttgctaagagcaataagtgtttgtgccacgcaattctgaaaacatcataaagaaacacctaggatgggtctgtctagaagcattttctggcatatcatctgctattagtagtaatacttttaatacattaattaataaattgaaactctaatttaacaggagaaaaatgccaaaaacatctaataaacgtatatatgttttctccaattatataattgtacatacaccaccaaccaaaattccaaaactctaattataagatgtttggttcttgaatgagaaacaagatgaaagattgaacaataataaataaaggcttaaatatgttttaagattttaaataaataattaaattttattttaaatttttaattaaaaaaattgttgttttgagtcatatattaaaatgtttgttttaaatttttagataatatgtcacctcacaaactaatatttctaacattatcaataattgtgagtatttaagaatccaaaacaaaatttgatcatttatcatacattttaaacatatttaaaccataaattaataattacctgattgttgtgagccagcatatcagacaaatgttccacgcttcgatacttaattggctgtggttttagttgatataagagaagcaattgtgagcggtaagcctgattttggatggattgtccaaaccaaatagttgagcccggtctcaagaatggccacaacctccgaatggcatccttactgctgctctaggatatattttgatgcacgcaacttcaagtatttttttctctgtttctttatatttgtaattagcatttaacccatgatatacacgaacataagcttaattatacattcacaattatttgtattttatttaaaaatttataaaattgtatgagaagtttaagttgaaatttatcatttttaagctaagcccaacaaggatggaaatattaaacgaagaaatgggcagaactggctaacccaaataccaatgccttaaattttttatctctctaaatttaagtgagatggggggattagtaacagctaggtgaggcgaagaaacagaaaaaagtgaaataaaaaagccacatgagatggagcaaatgtgcggcaggaaactatatttttatgctaacggggttataccgaggctggcgagtctcttctacaacattacattaactctgctacaccatttagcagccctcacttaaattaacactactgactgaacaaaatctggaagcaatcaagatgaacaaaaaaagagtcgaccaactataccctgtatacactcactaatccaaaaatcttatgtactgatacagtgcagtgatgatgatcaatgacctcaacttgaacaacttccacacagttggaagtagtaaagctcaacgggctgtggtcggcagacagtgttgagatccgttgacagaaagaattacataccacaattctaatataaaacctgcagaaaccacctgaatggctgatctcactaattgtggcctatacagagtagcctttcgctattttccctgtttttacaaaagcccatagatgtagcagaatatgccaaattcatcccacgcaagacgagaactcatcaataccagtttcctaattataaatctttactggcttctcgaaagtgtgccgattctgaaacaaaacgcatgcaatttgaaatggtgtaataaaacaaagttctctcaacctcaaaactaaaacccagtattaccagaatagtggacaaccacaaaacaattagaaagaccaaaatgaacttaataaaaattgctcttgcaggctaagttacaaacctggttaacagcatatgatcttttaggcgcattgtcagtatgctccaagccaagatactgctcccaagcaccataaacatctctcctctatcacaagatacaatgcaagcataaattcagacatgaaaatgatgctaaatatcaattgaattatcacaaaaaaaaaaaaaaaaaggaatccaagtataaatgaattacctgaaaacgactggatacaatgtcagaatcctgaaggtattcaggacgccctaatgaaaaaaaggcaaatttccactggccaaacaagaaacataatataaaattagataaattaacatcaaatttactaactaatatttataaacaatgaaacttccatcattcaaagaaaaattacttgaaaaagaagcataatatacccatagaatacactaagaggaaataccttgacaaactcatcatcaggaacttgaagtttcttctgtattcttactttaatttcagccaaagtctccccttcatgtatgaccaagaaaaagggttccccaaagttctgaatttgctgtcatatcaaatcaaatgggaaaaaaaaaaagtgacaaaaggttggaatacaactaacgtcagaatgaaatatcaaagccatcaaaatattacaaactccagtaagcaaaatgaatcagttaaaaattatataccatttggttctgagctgtgtctttagtgaaatgatacacatgaattagacgatcatgaggacccagatttttctcttcttctggtatctggaataccaagaaaaaagtaacacatttattttgatacataaactgaataaataaatgaaactataattgagtatttagaaaaatccactggtgcaatcatttcaataaataaaagcaggaagaattcatggactgaaagccatctcccttcccaggccactcaaaaacagaaagagactactacctcctctgcacgtaatgtccagtattgatcattaatgttttcaatcttttcattgggagggaagacctgcacaagcagaaagacaagacaaaatgaacatatttcaataagaaaattggactaatgtcctaaagttaattgcaatttcagtggcacaaaaaattggaggatcataagtcaatgctaaattaagtatattgaattctgattctcaaataattttggtcagaaaaaataatcaagagtattaataaatccaggagcagttaaaatagagataacacaacaccttgtatatcttgtgatagaaaacttcaagcaacctaagctcggcttcaggatcagacaattccacctgtaaaaaatgagcacaagaaatatttcaaaaattaaggtgaataagcataaactgaggaaaagacaagttgacaacattatgttaaaaatttactacttcaataactaaatgaagtactgaacaaaaccgacaaacatggcttcatgtatcttttgtttctaaatacagaggaagccatgagtgcacgttggttgtaattgtgatttcagtgatgagtaaatgtacagtttaggcatgttgatgaactaaataatactcatgcacaatgacctttgttttcagatcatcaaggacatcccccacagtgctctgctttgggagtctgatggtatgaataaccacctgaataaacaaataaaaaagtgtcatggaaaataatctagataaaaaccaaaataaaatcagattactatatactcacttcatccttggtagcatggtgaaatgcaactttcagagttttcaatccttgtaattctggcagagggatgtcaagtacttcatagtacaatatatccgaagtctgacatgcatgaaaggaataagatgttttgctttataaataagaaacaagttgaaagttgggacaagtcaataattacctgattgtagttttttttttttgatcagcaaagataatatatatatatatatgtagtaaaaagtgatagtacaagtggtaccaattacctgattgtagtgaaccagcatatcagacaaatgttccacaccacgatacttaataggttggggctttggttgttgagagtagcaattatgaggggtaagcctaattatggatggatcttccaaaccaagttgttgagccactttctccaccacatcatcatatgtatagagccttgacctagaaaatatacatagtataagatgtggatgcaaatctaagcataataatatataaatacttacatgtactctcaagtaaaacattgcaatatattaaatctaatgatttgctccaataaattacacaattcttacatctccaggcagaagtcatcttccttgggcttttctagagatcgaaagtgaacaacctaaaatacataaattagacataaaaaaattagcagatatcacacggtaaaaacataatgaaacttgcatggtatattggttacacacacacagatatgtgcaggcgtggacaagggggaaagcggaggaaggggcagaataatatgactgaataaatgggtagagtttcatttttgcatatcaatccatacaaaatgcctttaattgaacaccaaaaagaaaaatacctggcgattgtgcacatattctaggtatgaaggcacatctggatagcggacatgttcactatctatagcaggagctttctgaaagcatataatatctccgtcttctaactgcaaatatagaaaaacaaatcaataaaccaaccaaagatacggtaactcaaagtgcatcaatggtgtttataatttacctggcttgctcgaaatgtaaatttcttatcaatgggttcacacataacatttggctcaaacttaatttcctgcacaataatagtaggcacatttaatccacaaatgccacacaattcaagtcactcgttgacatcagaacctaaagatgaaaaataaaaataaaaggtccttctttagaggtcaggctcatgcagaatagatcttttttgttgtaacataatgcactttatttgtcatcaatcatcagtaaatttaattattaaacaaaagagactaagaatgctaaatccaagcctaatatctcaagaagcatattgtgtttagatcatataatgatgaactacagtctcaattttcaaggcattctgcaactcaaaatattaaacaatagaacacaaacctcatatagtccaatctcttcatcaggatcataaccagccattttatttaacctggttaagatttctgatggcttaccagtactcttcacaaagagccttccaacataactgccacaatagggaaatacatcttatgtcaacaacggttcaccttttaccacatccacatgttaaaataagatattactcagtaccgtagctcctctttttcaggatcatataacttgaagaacagtaatatatcatcctttgtcttgtcaggcggtgcaatgggacgtaaatcctaaataacaacatagtttgtcaaaaggacagaaattcggatattaatgattcatgctaagaaaatggtatgcaacttccataaatacaaatattaccagcccaagctccacttccaaaagcaatttcaattctgcattgtgaaccttgtttgatacctctctcaattgtccaacctgcaacaatgcaaatcagattgagaaaagacaaaatatataaatatatatatatatatatatatatataaaccttcagatcatatagaaagagacatgccacaaaattaagtaccaaaagcgggaagatataaatcacagaaaagttagcataaccaacggcataataaccaaaccacaggatccccaaaaaatagtatgaaaaaaactttatactggttgctttctttattcattttcaggaaataaaaaacaattagccaacaatggcaggcataaagtaattataagcaaagccaacacagggaataaactgttgggccagcccacgaaattgaatataaaataagcaacccgacaggacaattatgaaattggcatgttgattaagaaatgaagcatagaacagattcagcattcaacaagtgcagggtaaacaggcaattgatataaagctcaaaggagagtatctgagaaaaatatagagaagcttcaagcaagctcaagaatttacagattgtgcttcttccatgtgtgtcaatggtcgatttggacgatacgtatggttttgccgctttgcccatagccaaaagcgctggaattgaactggtatgccaaactctttagcaacctcttcctgcgtatcccacagataaaccagcaatcagattaaaaaaaaatcaagcttatgaaaatagaatgtcttttgagcaatcatctaagaacaacagatacttctaaatattagatgtatcatgtcatagctgttagatatctatccatgctaaacacttcataaatacttgtacacttttagatgcatttatatatttttttacttttctttaatttttatgcaaattaaattaaaatagcataataattagataaattttaacattttattgtgtctacaataactaatgatttttcaaacatgaactctctttttagatataagacttttatttcatattaatattaaattgatttgttgcatttatattataactgtgtttagtgctataatttttcaaatttgctgtgtcccctggtctgtgccaatcatatctgtgtcccttatcacttttgtgccctttcttctaaaaaaatttctgaaaatatccatgccaagaaacttgctgatttctatcgtattttggatttattttccagtcagcagcatttatacaatatttttctgtgataactacaatatctccctcttaaatgagtcattaacaaataagtcattttgtcagaaaactagtttgtcctatgttccaatattttcaacaaaaaagcaaccgcttaacaatagagatttactagagaccaaatcaaatcagacaagaaacaaatagggtatgccaggtcaaaacacatctagcaggagagctaaaagtgtgattaatgatgataccttaaaaaggttaaaagacgtctgtttttgaacacggaaactcctcactttgtcatggtctacaagatcaaaatatatatcctttccaatctgctctgcaaggtcttcatctcgtgccacctaagaagtatcacatgttaacagtttaggattaagcaacccacagcatctctatgtgaggacacaaacagtactcaattctaggatagcaagttaggaactagccaactatgaacctttataatagtgtaaaggtgagcctctgctttttctttctttttgtgctctttttcttcttgttctttcttcaacctctcctgcattaatccattgtagaaattcagtgcaaattttccagaataaagcagtagaaatagtacaacagaaatttaaaagataacagcaaagtgagcttggtttgattttggcttgagatacacccaaggaatttctcgtgagaaaaaacaaaaaatgacttggtttaggcagagtttaaattttgtgtgtaagagagatcaacttacacatagctattcttacgccatcaatgattttgtataaaatgtgatgttcatctatctaaccgttgactaataactatatattacctagattattcatgtcaaatccagtaaaaacaaaagataatcaattaattcttattttcatatatttcaaaagcggttttttttttgttggggggggggggggggnnnnnnnnnnnnnnnnnnnnnnnnnnnnnnnnnnnnnnnnnnnnnnnnnnatgaatgaggtatcaaataattttggattaatctaaaattttgcaaatatgatctatttgataagaactttgattacaatgatgggtttaggaaaaaattgctgaccaaaatgttaataaatagtgtgaaagtaggtgtaacttacactggggtaagttgctcctcatgtatatataaatagatagataacaaacataaaaataaaataaaaaacacagttgagaacttcagcacagtcatcaagtatctgaacagaacatgcttatcttaaaataaattagccatctgcatttctttgcaagttaaatttaaatgcagaagacaaacatgtagctatttgacttggcttgatttattttaaaccctaaagtacctaagaatagtcactcacccttaaatgttcagcaatgtctttctcatccacattgcatattactttgtccttgtcagcttcacgtatatacaccagcatataagcatttgaatatttggtgaatttaaaaggagtgttgttaaatccaggatttgtctgcggtaactgttaaaatacaagtggttaaataaccaagaagtaaatgttcaaatactagcaacaaccatttgcaaaaaagtaattacctcttcctcgccaccatattgctcctctaatgcccgtttagtgtcttctttagtcaccctctcatcatcaaatttatacctaatattcaatcaaagcatgcagtgaagtgctcagtaaagcagcaagaaatgcaaaacaaaataacaaaaagaaggtgaagggactctcagaaagttgcatgttatatccaagttcattcataaccattattagaaatgtagattatcaatctaatgacaagtgtcagacaaacagattctgcatttcaattgtttaccactgcaactgcctcatttaaaatataagatacaacatactctcatgcaactaataatggtatcgtttacaaactacaaattatgaatatgatttttcagttgaagtttagttcaattttatcatttaggaaatattttccttatctatgtcattttcatcacatatattttataattttatctgtaataagacactcttttttatctctgtaataaaaagctcgtttttgacttaaattaattgtggttcggactttcatctatagatcaaccttaaaaaatcagtatttgtcacatgatcctgtgtgcgtaacatataatcaatgaatatgaattttcagctttaagtttagttcaatgttatcatttacaagatattttccttatctatgcatatttatcacatgtacttttatgtataactttaagcatttttggtagaatcttacgatccatgttttgatccttcaatttacgatcttatgtaagatctcaattttgacaacattgggtatagctaattattcaagttttctcacaatccaaaaagcatgtgatgtggcccctagtagtcatcatcacacatacacaaaaacatgtagctcatatggcactgaaacctaaaagcagagtatacataccactgctcagatagagtcggcctaataaaagcataataatgtccaccatgcacaccaccactgtgaaccaaaacactgtggaaaaaatttaaatctgtcaaataatgaacatcaccgataaaaatatgcattcatataaaaagaaataattgcacactaatggacatcatcagaactgagaaagaaaaattacaatttcaatgaattttattgattaatatttttaaagggtaacttttaaactttaacattaacaatccaagtttactgtcccaagattattcacaaatacaatcccccacttgatttggaaaattcagaaggcctatgagatggctctcccaaagataaattgttttcttctttccattatctatcctcacatcattttctcctcatcctactttatcttctttttctttctatagattgtagaagccacggaacatggattgtactagactaagtaaatgggtaaaaatatgacaacatatatactgaaagtggcttctaaaaaaatcaaaaacaaaattgggcatcatgcaccaaatcacaatcaccaaataaaatatcatgaaacaaggacaactcctaaacaagtcatgaaaagagaaatcactagaagagcagcccaaataaaaaaccatgcagtctgcaacaaatacagctgtcattaccactacattacctatgaagtgtgtaaagattgcggacattcctatcagcatcaggtgataaatattttccattctcacgatcaaggtcaagttgcaagggaaactcataacggtcattaatctacatggaagaagaagaaaattaaacttccatttacagaaaagggagtttaaccattccatcaaaagagaagagcccatggactgaaaaataaaactaagtaatgcccataatccctctggcagaatatatcccttcaacggattgtttcaaatgacatacataaattttaaatacatgcacacacaaacaaacaaacaaaaagatttcccaccaagacccagagcaaaaataagcaaaaaaaaaaaaaaaaaaaaannnnnnnnnnnnnnnnnnnnnnnnnnnnnnctgcagaaatccttcatgattttcaatatcacaacacactattgtacagcacaagtcgtgccgaatcactttcttacatgaagtaacagtactgtaaatgaatacataccacaaataaagaaggatatcactgtagattgtcaagaataagtaattaatttaatcaatataaccttcaatggcattaatagtgagctagagcaaactgaccgaaacgaaaccatattactctgactgaatgctaacttcttcatatcctagtaacttgaaaagaaaatatgaatagagcaatgagtctatttgactactaaccttgaccatagtatcccgcataaagtcatattcaaatcttttcagttgaagctgaagaacaggagggaaatcaatgaacaggacacccttcttagcatcctgaaaaaatgaaaaatcatcggtttatacatgaaactatattaaaaaatgtatagattattgcattctgacagcaactataagaaacttaaaggattcagaacttgacaattgcaaacaaaacgatttttgtacacccaatataagaactaaagattcagaacttcgacaaatgacttattacaagtagattcttaaataaacaattgcaaccaacctgcaaaccatattgttccgcatgatatttgttatccccttcaagacgttcaacttcaacatacttgtcaaaggaagcataaacatcaggacagcctttcacatcaagctgaaggtctgcaagtatatgtaaaactaaattagaatcaagtggcaaggtacaattaaacacatagcttcagtctgtacatggaagtaccataaaatgactcctttctagttgatttatagtccacattgatgcattcgatatagttcatatgatgcccttcaaatagcttctgtatagttccctcaacaacagttccctaaagacaaaatgaacataatcatcatgaatttgagacagtattccacaaaaaagtttgtgtacaaaaaatccaaagatcatcctttaccttcatcttgtcttcaagtttttcacagaggactctgttcagttcttgaacatcatgctgcatgaaagaatcatatgtatcccatccaaaagatttagtgagctcctttgtcgcaacactggtgtcactatactggagcttgtagaataaactttgcaaagccaaagggatgcttgcagagggcatgtcattctctgttgttggcatatggtatacagcctgaaatatgacatccaggacccaaatccaaacttcctcatcactatccagtaaaaaaataaaacttctgaagaaaaaaacaataagagaaacaatgcctgacctttcgaaaataaggaatatggtacaaagtttggagtagagaattcatataacatgtagctccctggttcttaagtccaacatagccagtctccttttttgaatcataagtccagtaatcaacaattctacgaacaagaacctcggcttcaactacaagagtatcattcacaagataccctctactaggatcatacaattcaccaagcggcatgaaagatgtgaaaccccaatcactttcccgcgcattgaattggtgctgtgtgtctacacagtgtaaaatgaagttagacaaagcacaaggctatgcacaaaaattatgagcattttcactttattcccgtcacttctgtttcatggtaaatgctaatgagtgcccttagcttagggcacttgttaggaattcaaaaatacaaagtattaaataaaaggtcaaacattttaacctctcaatacattacatgcattatacaaaaatagtttccattttttattacttaacaagagcccttatggaattcattagtgagagtgttgttttatttaacatgttaatgcttacagttcttttaagataagtaatataactctatccagatttagatccaatgttacaaggaaaataatattcacgaattaaatgtttttaaatatatatatatatatattcaagaattaaatgttcttaaattaattgcaacaaaaatcccacaactttctttactcttacttcaagcaatgatcttttctacatacaaacacagtacatcatcttgcaacaattgtacggaacaaacttaacagactaccttttctaacagtgtatttattatggatttgattaacgactgccaagctaaactgtgcatatctactccagccatagggtaaactagctgaatctgcaacatccaaatacatggacaaatagtccacattgttcccttttgggaaaattagtacacgcctgcccagtaaaaaacaaggttcagaagagatcattaaagataagcacatcattgatcaactcagacagagtaaaagcatcataccatttataaccaccaacaacaaatatttcagaatagagcttctttgtattcatcctagaaaagttgtcaattttccatgtgaaccttgacgttgaaggatcctcgacaggctgactctccacagtgttggcagcatcaggttgagccacaactaaccaatcatcaaaataaatgaaaaagaacaactaagtatcatgccttaaatcagctgaaaaccaggggggggacaataaataaactagaccctctactcagttgcaaggaaagagagagaaaaacaatgataagatcaatcaataaagtcgttgaaaacacacaacctctccaaaatgcaatcaaacaagaaatcactttttgtcaggaaaacctataactctttaagaccaattcgtcacaagttattccctctctgtctctctggcaatcaaacaacgcatgaagtgtctccctgaactcttaagaaagtaagaaactattcaaatcgatcatataaaagccaacaaatagagtaacagaaaaagcgggggtttctccacggatcaaaagtgtgagaaagcaacaagtaccttccatgggttggtgattattctcagccaaatccgtgtgcgggacaagcatctcctcgtcctcctgctgctgctgcaaaaaccaaaacacaaaccaaaaagaaatcatcactatcaccctacttcggatccaccgaaaaccaaccccaatcaaatccccaaattccgagcacggaatgcatcgtaattgaagcaaattccactcgcgcagatcaaaaccacaacccctaacacgaaacccccatccactccgcggcaacccaaccctccccaccaaaacgacaatcaaaattgacaccattcgccgagacagcaaaaaggaacaaaaatcatgcaagcaaataagagaaaacgaaaaacgacgagcgaaattgaaaacgcgcgagttattggaagcgcggggggagttgcagagtgagggtaagggaacgtacgtcaatgggagcaggagtcatgacagtcatggcgattgcgcaattgacctcgcgtggcgttgcttatggagaagcaatggaagagagagaaagaggagagagaaagggggaagagatcactgtgagaaaacgagatcaccagaagctattgctgtgttgctattgctcgagacaagagggagaaatgtccttggtttttatttggggctttgggcattctcggtatttcacctctcatatttctgtgccgaatttctatatattcaataactagggaaaaaaataaaaataatagaatggtcataaatgtggaattttttacggtttcttacatggatgtgtctctaaaccaacaacaggtgtcgtggaagttatttgtatttttaataaagtgatttagaatttcagattttttatacgaaacaaattgtgggagacaaagaagaatacacacacattatgtgtttttatagtttccaacgggaaaaaaatgtttcttatcttaatgtgtatttgtttctaatcctaataattaattggccatttgattttttttcttgacttaatgtctttacttagataaaaacaaaataagaaaaagtttacaaatttaaaaaatcaattaaaaagaataaagactacatttatgttaatcctaataggtaacaaatcctaattaattgtgtatttaaattttttcaagatttaaatttctttacttagataagaataaaatatgaaaagtttccaaatgtaaaaagttgattgcgaaagaataaggactacatgacttgttgaaaaatttatttatactttaccatattcgattataaaatatcatattatatatcatacaattatattgtatataatagtttaaaatgttatttttatctctataatttattcattttcatttcctataaaaataagataaaaggtctctaattttattatttattttatttaatcattgatgttataaattattgatgatgattaacatgttaaatgtcacatcaaaaaatgataacgtaaaaaaaaactataatgatatagtgtcatgtcaacaaggaaaaaaataaaaatagatatattttagataaattaaaagcaaaataatagcacatatacatgtttaaaaaatttaaaatcttaaaatagatatgaatataagataaatagttaggtatatattttgggaattataaaagttcatctttgtttatttttttgttataagctaatttttaagatttggcttgtcttgtttgaagatttagcttattctaaaaggtgttacattaacatgaataaaaatatgttttacaaaaccacaatgttgagtcatagttgtaatgataaaggaatttcattttaaagattttgtttggctaagagcctattctagtgacttgccccgaataaagactttgtgatggttgcaccataatttgttgtttctacaaatttttactagagttaatccatagtgtaatcctaaaatcatatttacaccgccacctatgactatcactcaaaaaatcatagtgccaagacaatattgtccttcattgagacatgcatgactaaaataagtcgaattgtttaaaaagttcaagagctaagtcttgctagcatttgtcatgagctataatcaaggctttgtttgctcattttcaaagtctatcttagtttattagacaatctgttaaggattaaaccttcaaatagaaagtcacataattagacctccaagctagccaaaccttcaaacaaaataggccaagccttgatgaaaacttaaatccattttttgccctataaatatgtccctttttttttttgtttagctcttataaattgtattatatttttgtagttcttataaataatttttttagtccttgaaaattattttgtttttgtttgtagtccctaaaatttgtttttatttttagtcattgtaacttttttaagtgtttgctgatgtggcatccaaaacattacatttttatgctaacatgcaacctattaatgttatcacttgttgatgtaacactccgattgaacgcacaccacaatgaggaagatctagaggttgtgcaagatggaactgtattgttgatgattacttaaaagaattacttatactaaaaaaatacatctattccatcacttaagaattccatcgttacgtgtatttgactttgatcaattttaggatgggtgatcctaagaatttttttgtgaagtgttttagtaagattaaaatacgctgaaaagtctcatgttagtttgtgggaaacattcaatgattttgaaagcaattaattgttacaaatgttgttagagttggttgtcgagtttcaaagaaggttacatacggaggattttgaagtataaagggttataactaatgagaaagctaagtaaagtgttggagagtgggtcatcgagatgtcagttctcaagggcattacaaatggtattaaagcatacttttctaccagtatagtgtgctttgaggacgaaccaaacaaaaaatggttgacatgtaacactctaggcaaagaatactaaaatgagttagatctatatattgtgcaaatatgagattgtattgctaaaaataacttaaaggaatcaatcactactatctatatcaacaaaatgtatatattttttagtagttcatccattaagaattttacaatttagcatacttgacttggggcaatttcataatggttacactttaggaagtttttaaggaagcgtatgaatgacggtaaagcatattgaaaattttaatgttgatttgtggtggtagtcaatgattctgaaaagcagttgactgatacaaatggtgtgtccaagtttattgttgatgtctcataaacaataaagaaactaaacgtaaaaaataaaaaaataacatattccaattgcctctttaaaaaatcttaggaactaaaaaatgagaaaattataggtaaaggaagtacatataactagggatggcaaagtgggccagcccatccaaaaacgggccggactggcccaacccactaaaaaagtgggccgggtcgggctggccggcccacttttacaaagtgggctgaaaatactaacccaccccactttaaagtgggttagtgggccagcgggccagcccacttaaaaataaaaaaatatatatttttttttaaaaaggtaaaaaaattattaaaaaaattcaaatataattatttatactaaaaattaataatgtactaacttaatcctataacaatgatttttaatataaaatacatgactaatagaagcaaaaacaattaggaaatacatgtctaacaatgattttcaattagctcctaagtcttaacaaattcttagaaatttgcttcacaatgatgcagttaatcaaaacatatttgtacatgtagtataactcattattaggttccaaataaaaatgtattagggttaaggattcaaaatcactcacttcttcttaatcactcttcctctaaaccactcatttaattacctattaaatattttttaatttttttattggtgggctactggcccggtgggctggcccacccctggcccacatttggcccacatttttgtgggccgggttggcccggcccgtttaataaatgtgggctcaaaatctcaatccgacccacattttttcgtgggctaaacgggctggcccgccgggccaggcccgttttgccatccctacatataaccttaaatataaagaaaaaaatgagaaacactttttgcctctttatatttcttataaaataagttgaaagagagaatagaagttaaaaagaaattagtgtaatagtcaaataaaagtacaaacaaaaataaattatttaaaaaaatgttatctttacataacggtatatatatatatatatatataaattcatatgtctatatatataaactaaaataattatcttaaacaaaaagattttgtaaaattattcttaaactataatattttgaagtgtttttctttttaataaaagtgtttttaggaattgttattaactatcactttcattgattgattagtgagacatatatgtttgatcttaatctcatatattgattttttttttcattcctttcaaatcattttatttactaataacttatgagtctgaatataattaggctcaacggatctcttaattagagttttggatttaaatatcataaactaagaaacttaactaggaagataaatctaacaaaagtgataaacaatgtttcccaacgaagatactaaaaatatacataaattatattttatattttactatacacacacaattaaagacactctatatgtccaaattcttacagattatgtattttggcttcgtttttttcgctgtaaatcgatgtttagaaaaagtatgattttttttcggttgattaatccctaagaaaaaatttaagtgtttactgtttaaaatttatgactaacaaactattttctttttgtgcaacacagggaacttcttttttgcttcttacgatgtcgtaactttttataatgcttgcaatgacgttttggcatttctttggtaaacgtcatttctttggtattacacccgctgctaggtcttttttattacctcctttacttttaatttaaagtgtaataattgcccccgagaagtaatgactagggatgataaaaagagttgatatataagaaacgggcgactgtccaaaaaatataggatggattgagttgtaaattaataatgtaagttaattttatttttttatgggttaaataagtttatccgtctaattaaatttatttttgttataagatcttttaagaatgataaaatgggtcaatttatcaaaaatggattgactgatcttaattcaaaaaaaaatagaacgcgtcggactgatctgttttgtaaagtaaactaacaatactaatccaaccaaatttactttataattcctatcttatttatgtaatatgaaacttgttgagcgccaaaatttataccaaacacgatattggacatttatttttatgtagaaaataatttaatttttgtcaaacataaataaattgtttatgaaactttactttatccaataaattaactacgtaataattttttttacctaactaattgttgatcacttcaattattaaatttgtatttatccaatttattgacaagctttgaaacaaatcaaacaatgtttatgtcatagctttctactaacttatctatttagattatgttgagacgtacaccaaagtaaaaatatacactctaatctaaaatgatttattattattattattattattatataaaatcttacatcagctctcaaatttggataaaagttgaggattgttttagattttctgtatttaatatcaaacttatcaatatactaaaccagaatcttttatgataaattttgtatgatttcttaatttagtttctaaatttaataatttgttattattttaatctcaaaattaattaatcattgacatttgattcctgaaattaattacatattatcattttagtccttagttatactttaaattttttaattaagtctcatactatatataaattattagcataatcatcatggtatccttattttcattttatatcccttatatttttcacatttttcttagacattctatatttcatcttaatttttacatctaccatttgaatgtaaaggtcatcattcatttattcaattgagacataatttttaataaaaaataacnnnnnnnnnnnnnnnnnnnnnnnnnnnnnnnnnnnnnnnnnnnnnnnnnnnnnnnnnnnnnnnnnnnnnnnnaaatatcttaaaaaactttgaattttttcttaataaacattgtctagttttcttaaaaaaaattattttattcaattaaaaatttcaaataattttgtcaaaactctcaatattacatttaaaattatttgatgtctatatataactggtgataatagttcataataaaaataacttttattatttacatgatatgcatgattctttcatttgggtcgtcgataatttactaatttattacatggatctatgtcattcctcccacttatgcctcctcttaccaagtaaataacacaagtgacattttttccatgacaattaggtttagaggtctgagataaacacaaacatttgagacaaggaaaaacatttaaccgtaaaatgaatttatcatatatatttgaatttttcatcacactatccggctcacattttcacatatgaaaatggatacttaaaaaaaaaagtgtcaaataatatgtcagaaatcagatgtctaactctctctgcaattctgcatcttatagactgtacttcgaagtttgaagcgtgaacagctgaaacatcaccatcatggcgtttcccaaaccccgtcagagccactcctccgccgcttctgctccctcccaccgccgtcacctcgcgacgaaagcgacgccgaactggtctcgaagcccttccacgccactgagtcaagcctccagctccacggcatcaccctcacccccaccctcctccgcctcaaaaaccactccaagatcgccctctccctcttccactacgccaaaaccctccccaacccccctctctcccactcctcctcgacaccatttcctaaccctctttcgccgcctcatctgcgccggcctcacgctccaagccgtacacgccttccacgacatcgacgccttctcagaaaccaaaacgacgcccgaagacttctgcgtcttgctcgacacgctctgcaagtacggccacgtcagactcgccgtcgaggttttcaacaaaaacaaacacacattccccccaaccgtgaaaatctacaccgttctgatctacggatggtgcaagtttgggaacgttaaaatggcgcaaacattctaaaagacatgattgatagaggaatcgaacctaatgtttttacttataacgttttgttgaatggagtttgttggaaggtgagtctgcacccggaggagaggtttgagagaactataaggaatgcagaggaggtatttgatcaaatgcgtgagagcgggattgagcctgacgtgactagcttttcgatcttgcttcatgtttatagccgcagcttgtgctggataagctgaggttgatgaaggagaaagggatatgtcccaatgtggtgatgtacacttcggtaatcaagtgtctcgcctggtgcgggtggcttgaggatgctgaggttgcttgaggagatggtgagggatgaggtgagtccgtgtgccgcgacgtataattgcttcttcaaggagtttagagggaggaaggatggggagagtgcgttgagaatgtttaagaggatgaaggaggatggattgtgcgcgccgagttcgcgcatacgtatgtgatattgattaggatgtttttgaggttggacatgattaaggttgtgaaggagatatgggaggatatgaaggagactggggcggggtcggatttggacttgcatacggttttgatacatgggttgtgtgagaggcagaaatggagggaggcttgccattattttgttgagatgatagagaacggtttcttcctctgaaacctttaaagggggctgattcaggctgatatgttgagaacttggaggaggttgaagaagaagcttgatgaggaatcgatcacgtttggttcagagtttcagaattatcaattgaagccatacaggagatacgctacattattacacataattctgctataggctatttcaaaactaccagattccagaaagagatgactaagtgggatgtataggtctgcacctcatgatatgggtaaagcttgtggaaaaaaaaaggttcttacggaagaaagtggcattacaagttacaattctacagaattacggaaatcaaaacatagtggttggatgacagagcatcctggagaattctctccttttaaatccaaaaggaacagttggagggctctggtaacaaccatctattgaaatttgaaagtactaaagttcattcttttactagtggaagttatactacaagttctaggacgaggagggttcacaatggaacccctaattcaggaggatcagccaaggcttttcatcataggttcacaacatctagatttgacaacctggtagggatggattggggaagttacaactggtggtagctttcttgattatactatatccgtaaaccaatataatcaccttcattttgaagttcttaaatttatattcattctcttcttttcttttattctttctatacattgtagtgacaaatctatcagcactatcggtctttgaatttggtggggagggggagggggatgtaactgcaccccgaactgcctcttcttgtttgtcttatcatccaagttaagtgttatatttaatgttttaaccaaatgaatgacgataatgtgcctagacttgagcctttggacgtgtgcatgcaaagtctcttatggtccgcattatttggttttattgatatgtattttacataggccaaaatgagacgacatatgtttagatactagatactggaaaatggaaatgatgtgatttcctgcaagtctgtttttttttgggggggctctatgccttttgccaattaaattaggagagtgtagttgtgtttgaatgtaagactccttggcaaatttgtaagacgatggaattctatgattggaagagcatgttatttatctgatcatctgatgagattggagggcatgttatttaagaccatcttatagcatttgctcgaatgaagaaattctttacaatatttttatcgtattttaaattggtcatatggtatgaaaaacttaattataatatttggatgaatgttgacaagattaattttgaatgaaattaagtttgtaaaattgattttggttaaaattgatcttgaagtgatatgatttatgttttgatgtttttattataaaataagttaggaatgaattcattataaaattcttgatcaaacttcagttggttcaatttataatcaaatctaggtataaaaatatgtaaaaatttatttaaaataaattttggatttggattcaattctttaacctacacatatctctacactcacattaagatatttttttcatttaccatactaattgtaattagaggagtttgatgactatccctaattcttgttaggctgttgtataaatcaaatagattgtaaaatatgaagtttataagttaaagaggtcaaattcaagatattttattcttcttgtaattattttaatgaaatttgccattgcttccatattaatgtatggaaagtcaatgtagaaaatctaataaacattaatcaatatatatttttcttcttaaattcacttttggtcccataaatgttaagaatatgcacttttagtctctcaaaataattaatgcatgtttgaaatctccacatttttttaatttaaaaattttgatccattgcttttttagaaaaattttggtccattattagtttgtcgttaatttttttttttcaaaaattattgacatgataaatgaactaataatctaatatatatgtaaatgtgacactaataatttagtgacattacaacaatgatcacaatttggatgatccatgtcatttagcatatatttacattgtcatgttatttataataccaatgtgtcagtattacttcatcacttaaatataacattaattttgtttgttaaaaatttgatggcagattaacaaaaggccaaaattgctaaatttgataaacattgaggataaatgtgtaacaaatttttgaggggccaactatagaatcataaaactatagagggcaaaagtgatttaagtctatctttttttatcattgatgtaagcttatcttttgtaaccataaatatttttcacgagacaaatatattcaagagtatttacagggttattctacttttcttaacaatatgccatacttaataaacatatgatgagttacaactaaacaaaattttataagcaatttcatataaatctaaaataatttcacacagattgttttgcccttttgttgttcgatttacttaaagatcttatcatgagattgattgcgatgagatgatgcttttggtttttgaacccagggtaggtcttacaagattcatttctaggtctatattatatcttagaacatctttagtggtagattataaattggaatcttagaccactttttggtagatcccacaatatcacataagattgaagatctctttcatttttgtcgttagtagtagatctcattttgagatcttagataaattttaatggatcccacatggatcccacaatgccacttttttttcctcctcctcaatgttcacttttctttttttctctcctctcttcacgccaccttttcttcttccttcttcgccgcggttccagcttcccatcatcctctgccatagccaaccccttccccttcccctccccctccgacgcggccaacccttttcccttgccctccgggcgatcgaccccccacctcccctttcctccacgcgcgcgcgaccctccttctccctaatattttttttttcacttggttatttgtttttcttcttcttcatttatgttcgttatgttcttacttcattctaatggatatgtgttttattgttactactattgatgaataattttttaaaaatctgtgtaaatcttaagaatttttgtgatagaactaaatctgcagtataaagatcttaatgagtattttattgttagatctaaggaatattaaatcttcaatttaagatctaacattaaaaatactcttatacttctcgaagtcaaaaggagtgttatcatctttcctgacccatttggcagtaattttcatcgatccatgtcaatagcagtcaccacccacacatgatgtcacaatacctgattttggctatcaattaatgctttaacctattcaattattcttgcttctttctatgtgaatttcaacctttttttctttcattaaagtcacttctagttgtgtatatcacgaaatgagaaacctttcactttctcacttaattaattgcacccatctattttcactatgaaaatctaggatcctcaaagaaattcaaagcaccattttcatctcaaaagcaaataggtaacaaaaaaaactatcatcattcatcacaataatacctcactagatttaaaaagcacaaatctcacatcacattcgaacacacactaaatccaaatcatatatgtttgcacccctttttcatcccctcccttttaacttctcacgtactcgtgtcccaaaatttttacccatagaaatttttctgaacaaaaacaacccacaacaatttcaaaataacacacccaaaaagaaaaaagcagtctttattactctcttcagttattgcagtcatgccttccttctttcacaggtccaatattcattcttccttcccaagcatttgattcttccaccactttcccaaacaacaaaaccctagattttctctttccaatcacttaattctctgagttcttcacccaaaaggcaaaaaatactcaaagtcccccctttttatttttcatttcaatcacatccccttctcaattctctgattacctgatttattcaactgcttctgccgtttcccctttgcataaaccccaatttcttcacgtgggtctctgaaattttttcaccttttcctctctgatcacgaatgggtatggcctagttatactcaacattttatttttatcaaataaaaggaaccgtttttttttgccctgaatgagttgatttttttggggtagtttttgttgttagtgtatgttgggttgagatttgagaagcatttttctttgttgccaaacagtttgcagttacagcaacaatgtcagatgacatgctcattcatttctcatccaactcatccaaccaatcagatcagtctctgcctacaaagattgcaaaattggaagctcgcatggttggtaagggttcctccaccactgctcagcaatcaggttggtcctctgtgtttgttccttctgttgggaaatttggcggagctgctgaaaatttggctgaaccatccacttccagtgattctgatgatgatgtaagtcttattatccctatatagtgcaatgtgtgtgggaatttgactgcatttatgaggactattgttgttatggttttggcttatttgcttaaggttttaaatatcggtgacaatcatggtcgcattgtggtttcgtcgttattgttgatatcatggcaaattgtggacaaatgtggccgatgcggtcccaattgtggtcgtgttgcagtcacagccttgatgttgcggcccaaatcacgaccgtggaccattttttaataccaacgcttgtgttgccagggattgtcaatgttaatatagaagcttctcttgttgtttgttttggtggttgattgattgtgtatttatctatggtttaggatataataaatgtaggtggtatttttgtgttcattgctgctgtttttatgatggtgacttgacatgaagattatcggtgttgtgtgtttattaatgatctggaatattggttgatgtatggaaatatattcctgtgataacttgactgattagattgttggtatctttttatttctgttctagaatggtggggaattcttaatacaagccaacactcagaaacgccaaaaacttcaagaagatggcagcacaagtgtttttgaacgtgttgaggttggttttcatgactccatatactctttgctatagttatagaatagctgcatctcatgttgaaatttgtaaaaacagctactcactggataagttgcttacttttaaaggtctcgcccttatcatctatttctattattctgatgacttcattaacaactagtaagaagtgtactttttgtctcagaaattggtcgtctagttgtttccaacttaaaatattttgcatatcaggttgttactgatgcaaggcaaactagtttggagaccatggagacaaaaattaatgctgatgtgaatagaaagaaacatggccgtggaagagggagttctggttcaggtagaggccgtggttccagagttactgatcagaccaaaacacaaatttctcctccaacagttttggcttcaaatggtcagattgagaatgtatacaaggtatgctccctcccatgaaatatttgttaatggaattgtaatttgtcaattgtccctatcagttttttttctttctaaacttgtcttttcaattgtgtttatatatctgtagtcaatacctgattggatgcatagttgcacaaccgtgtcttctttaactgtttttaatggagacctgaaatttaaacttcttggcttaaagaattaactgctggaaggaatgattatatccatccatagctgataggaaatttgttgcactgatcttggtgcccgtttttgctgcttggtatttttgaatggttactcaatatcagtgtaatgtcttttaattttttaaatcattctctgtatttggcaaggtctatttgatgttattgtctggttgcgtcttttagctcttggttatgcaaattggaatctttcctgattcctatgaatttctattcataagctcaagaacgttatattgcttaagcaattaattttacagattgatcatttatattgtactccttgattgttccctatagagctcatatttatttgcaggatggcagactcagtgatcagtttcatagtgataattctgcttcattacaggtgcggatttggcctaattccactcgtaaattttatggtcattaaaagaatatgtggctttgtatgaaaataattagaagtttgatattacttttttcatttctacctccctccaacagatcccaatgacattgttgatactttaactatttattgttgtttgtaatttttttttaaaaaaatttcattatttcatctctatattcaattaggaggacgttgcatctttacaagctaaagttgttgcattggaggaggaattgcgtaaatcaaagcaagagaccgctgattatcaaaatctttatcgacagttagaaaaggtatatgtataataataccaaatgctaaactctcaattgtgaatcagaaggatgttttctgaatcttgattttggcatatgcaggaactgaaggagctgaatgatcatgaacagcaaatgaagcctaaggtgtgattattttcagtttttgattgctcggtagttgtaattaaagtttcctttttgaatctatcaaaatatttcactcctcattatgtacatgttgtttaaaatagatagtgctggctgtcttaaattttgtttgtttgaattctatatgcaaaagtgaactggaaatcttagacagctccttgttgatacaagtgtgccactgccagggtcccgctcttctaaagtgagcttcttattttagagagtaaaataagcaatatcagtcgttgatattacatgcacatgcatgtgttggaatattaaagtattaaacattgattttctcatcaacgattgatgctactttacctatactcaatttagaagagccctctgctaccactccctcccctcccccaactaaatggttaataagcattctttgtaccatgcatcaattaagcagcagcatattaacatttgatccttctgttttgcagagaatgaaaataatatctgacttactgatatctgtttcaaaggctgagagacaagaagcaaggttgaaagtacggcaagactcattgagacttggaaatgttggtgtaatcaggtatgcatggaccattttaagaaatttcttaaatctcagatagcagagtagctgaccccaaaaccactctagtgggataccagatagtgggatgacttctactgtgaaattttagttacaagttcaataacttatatatagacttatataaattacccaaaattagagacattcatatgctggcaataaagaacagagaactggattaaatcatgaaagacctgtgcaagagtgtttactgcaagaaaatgaaagggcaaaacaatctttaagagagagcagagagcagtgagagagtgaactgaacagagcaaggctggaaacaccaagaaggtgcacctgagagagtgccaaagaatagtgggtcatgtttcagagacacaaggacacaattgttttagaatagggtttcgatttcgaaccccaaataagagaagcaaaatcatgaaataccccccccccccaaaaaaaaaaaaaaaccttaaaaannnnnnnnnnnnnnnnnnnnnnnnnnnnnnnnnnnnnnnnnnnnnnnnnnnnnnnnnnnnnnnnnnnnngatacacaatggcttccaaccattaatcaaagttgcgcccactaattccatgaatagccgcaaatgctccacatgtgacagtgatctgcgacaccacgggcttcaacagagcggccagtagctgcgatgcaatgcaactgtgctatagaacacgattgaaaactgagaaattatatttaatatcatttttttaatttcttattagttcaattatgaattgtagagctggaactgtcatatccgagacctgggaagatggtcaagctttaaaggatctgaatgcccagcttgtacgttccatttcctttctcctccatgattttttctttttaatttttgtactggagattattactgattgtgatcaatttatcagattcaacaaggatttattgtgagatttattctgatttaggaattattataacagactatttttaggattctgattctttccttatttaatgtgataaatattatccaaattgattttttcggatttaacatttcatagttcaatataattaaactgtcattatctgaagacattttcatgttttatttgtgcagtgaaataacatgcttttcactatccttcttagattataaatattattaaacctgaagtcctgaacctttttgattcagttggacagatgactgaatacaattataggatagtagtgtttttggagtttcaagggttttccttctcagtaatatttggttgtagcacagggtatataatgtcaatgttaccataacttctgtctgttagttttttgcaattgaaaccttgcctatgttgatagtttgcatagtgatgtcatgaattacttttcctcatcattctttgtttttccccagaaacaactaatagaaacgaaggaggcaatcgagcggcagcgcaaattatttaagaaaaaacaatctggtaaattctgtttccttttttcttttagcacttatcacctaaaattggggaagaggggttgatgggaccaaatttgggactgtccttttcacgtctccattatgccagttgttggtatgaacattccatacatcttgctaaatttctacattgagtactttgtatacattgactttcaatagctttactagatatgtactaatcatgaccaaccatatgctccttaagatggcctaatggatatctggatactatcaatatctgtttcacgctattggatactgctagactatcttgtaatatattactcttgtccatgtgttaatagtgtgtgttttgtttttgtttggtccttttctctgattgaagataagagtgatggaacagatgcagaggctggattaccagaagatattctaatccatgatgagatctacaagtctcgattagctagccttaaaagagtaagttgatatttctgctggtccgattgtttctttcctctttatgtttctgatagcaggaaaatgttcaggaagaagaaattattttgcgggagagggaacgatatgaaatagagaaggggaggttaattcgtgaaatgaaacgtatacgggatgaagatggttcacggtttaacaactttcagattctaaatcatcgctatgcgcttcttaaccttcttggaaagggaggattcagtgaggtgtacaaggtcagatcagaactatcaaaaagtataataataatcatttgatcatattgatattattttagcaagagaaatgccaacaacacactctagcacacttttataaattatttattatttgctgaaaattattagaactcacaaaattgtgcatcaatatttaacatattcccgctaatgattttaaagtttccaataaatttaactaataaattaataatagaaagtatgttgctagcactcctcttttagcaaatattatacaaggttttgagaaactaaagccagaatctagacaattacttggcctatgttggcaattgtaaataaatacctttttgcagtgatttgaagtaagaaatttccagcaggctttcgacttggtagagcatagatatgttgcatgcaagcttcatggtttaaatgctcaatggagtgaagagaagaagcaaagctacatacgccatgcaattcgggagtataatattcacaagactcttgtacatcatcatattgttcgtttatgggacatttttgagattgatcaaaacacattctgcaccgttctagagcattgtagtggtatgtactgttgattcaccgttttcttttgatttagtattttagtgtttttccaacccatttgccctttgacactcctttattcttcttctagggaaggatcttgatgctgtcctcaaagcaacacctgtattacctgaaagggaggctaaggtcatcatggttcaaatttttcaaggccttatttacatgaataaaagaacacagaagattatccattatgatttgaagcctggaaatgttctgtttgatgagcttggtgttgccaaagtgactgattttggtcttagtaagatagtggaggatgatgtgggatcccaaggtatggaacttacatcccagggagctggaacatattggtaagtggtaaaaatctttgttggaatccaaaatttgaagtggtccaagtttgtatgattaaagcgtcactctcctcaatctgacttaacctttgaagctccttttaatgtttccttgagattccaatatttaatttcgtaaaatatcttatgcattcttcttttcctttttcaatttgcaggtatttacctcctgaatgctttgagctcaacaagacacctcttatatcatcaaaggtcaataaatttctaagttgtaaagacaaggataaatttattttattattgttattgttattattctcactcacaatcactttggtccaaaggatatttcactttgatgcaagtgtcacaatggttgggattgcaaacaactaactcttggatcatcaccttaacatattttttgtcatttggctcttgtattttctaacactttgtggaaaacaggttgatgtctggtctgctggaattttgtattatcaaatgctcttcggtcgacgtccttttgggcacgaccaaacacaagagagaatacttcgcgaagacacaattattaaggcacgcaaagttgaatttccttctagacctaccatttctaacgaggcaaaggtgagttgcacccttttctgataattgctgctcatggctgattgttctttggccttatttcataattttgtttatttacatttgggtgttgttaatgaaccccctaagtgcattgatcgaggaaccaaaaaataaagttttttggaaatcacactgaggtgcactacaaatcatggtagacgtgtattaataatatttttaataaaaactttcctcttttgatttcttagtcagtgcatttgcctttattttattctgattttcagtgatgtacacaactatgctttcttgtaaggttatatttatggtaatttcaaaaaagaactatccaactttattccatatgcaagtgtaggaaggtggttgtttccattaaagacctcaaatatatacatacttatatctggttaatagtttctatgtttagctgtagaaagaaaatagtacctactatctacaatactgtcaaagtcaaacctgacaattgtctgtgctgtatctacaattaatttggtcaggattttattcgacggtgtctaacatataaccaggccgagagaccagatgtattgaccattgctcaagacccatatctcactttctcaaaaaagtaatggcattcatttacatggcttcattatccagactccacggagaaagaatggaggatctcatcttctaacttcagttactgaatctgttaaattttgtataggttgtaaagatttaatcttgtcaatgaggcagagagggggatttccccattctgaaaccgagtccagttaatttacatgcatcaccttttggttcaaaatatgggggagcaaatggcatgtgggtttgatttgacctcaaaaagggtcaggaagtatagttactcactcgcaagtgaaaaagcttgtgttatttttttaatactcttgcttccaaatataggattttaatgcattttgattggctactttatcttttttttttttttcccaccaagctattaacttgtggagggagagctaatttattttaaggatgtttgaaaggtttgttttacatttggctgccgaaatcgtatatggtgtgttactaacccaaagaaaactaataaatatgtggggggcatcatgaaaagtcagatagcttttttaggatatgatttctgagttaatgaaacgaaatataaaaatatattatgattgaaattagttattggagctgggagcacgcgtgcgacgccatcgcttggttctgggaggcacggcttgtgaaggggttgatggaaggaaaggaggtgaattggtggatggagagtgaacggttgaaagtacttgattagaagaatctggtagaaaggtagttcaaggagtttgagtctgccatggagtatttatccaagtatttaaagagtgtgatgatggatggtgtccgaaacaagtatttcggaagtatatatatatatatatatatatatatatatatatatatatatatatatatatatatataatagagaaaaggctgatgccttcttcagtttatttacatctatttatagatacattgctactccggatttgtccctccggatttcaaacttaatttaaaagtacataaacagttacaagataaaaaaagaatggatataaataaaagtaaatactattaagacacggactatgactatatacacagacaggtatcttgcacagtatcagctatcttgtcaacagtacttctgtcttctgccgacaattctcattggtttatttcttgtctctttctgctgttatcttctaactttattctgaaaattcttctttagtaaaataatccagcatatccctgttcttgtgatagggattggtactggaactgctaccttcatcttttacggatttttgctcttgagatatccccttcattctctgtaacttaacttcgaattcttcttgtgaagttgcggttgctaattccgccattatttgacttttttgtgctaagaacaaagcttctttatcagcatctatatctaactgacttctgggaattttattgtttcttgcccactgtaatatcttttctttattgatcaaccttatatcaaactttttccaccattttatttttacttgtctggagagaaagtataaatctgtaacattatctgttttaacatatgtataagtccaactcataatccacgttatcccttgagaggctataaacgataaaaacttgtatccatccacaaatttagtattgtctctaaaaaatctgtatagatctttcacttccggaggaaagacttctctcataggtccaaaattgaaaaaccatttaataaaccattttgggaattttaacgatattccttttttgaaccataaaaaccaagaatgcttatcgggtttcagatataaaatgttattccaggctgtcatatagtcataataactgtattcctggggagtaaaggatcttgaaaaccttagtctggtgaagaggttgtccccaatctatgtcggacaagacattaaggatcttgagcttggaaaactgtattacaccttcattatcttcattatggactagttctatggaatctgtgtctataagaatatattcataaaaaattctagttttatggatatctggacagggatatggaaggtcttttggaaatattttctcggctaattgtactggggctaattttaaccaatgtttttctgcaataatgattgataaggtattttcttttttaatataatctgggtctgtatcagtatgagtctggtaagtctgggtaatgggtaatcttgatgaagaagttggtttatcaaaatctctgggtccaactaaagtattaatatattgtaacggggtatatctattagtattggttgctggagctctaacaacatgagataaaatattgggtctcaaatttagattggttaataacctggaagttccagtatttgccaacggcactattgattttgctgggtctttatcggaatccagtgggaatccatattgatctttagtcaacagctttttaccagatttcttaacaagagaattttcaggttgtctatatacttttaaaatagataattcagaaacttatttaggaatacctattccagaatacaattttgatattctaaaataggtattttagaataggttttgggaatatctataactttttgaaatggccatccggtaacaaaggaaggataattggggaatttaaaaacatctgagggtgcaagaagcaaaaaaaatgaagtgcaagaaacaattgcctctagagcatgaggcctaatgttcagcaagaacgaatcgcggtaaatatcacagttgataatagttctcattaagacctaacagaaattagaatggaagttgtggtgttatgaataattccttgaagtaacattgagagacaactggatccattaatatcttaatttggatagatttctcgataaacacttaaataaaataaaataaatcaaagtatagtataaaaaaggtcctgcatatattaaggaatatataatataggagatgtaaaattgttttgataaaaaaaatacatatactaatactataaaagtttttctacggttattaaatgagaaatcataatatacggtatgtttattaatttgataattatttttaattctttgatttattttttaaattcaatttgatcctcttattatttaaaggttcaattaagttccatactttaaaaaacaattcaattaagtctcttactttttaaatattcaattagttcctttatttttttaaaacaaaatcaatttaatcccattttttttccatctaatccgaaaatttaaaaaataagaccaaaattggtgaccaaaacatatatatgtttatgttagacaaatacttgtgtacttaatgttgccccaagtttactgcaatatatgcagtcgaatggcaatgggcaaagctgacaactgaaaagatcacctcaatttagttgttaactaccaaattggcaaataatttcatagatattaaccacacaaggataatcaattgtatttttttatttatttatttggatatttgttcaagtattcccaaagacatacctatgaaaataattcctcaggtcaagtactaattaggtaaaatttgctctgcgatgacttatgattcaaaacattaccattgcaagtaaaatccattcagattaagggtataaataggtacatatcatcagcaaatctaaattatccaatccaactcaaacaatttgaattggatgatcgacctattaacctattaatttgtattaaattattattattattattattaatatatgtaatatataatatatatttttaaatttttaaaaaataaaatgttttttaactattaattacatacacttatcgacttgaatttaataaacattaacgcattcttaaccttcaagatcaaaacaacaagaattttattgattaaaatcactttagatagacttctaaaaatatttttaatctatttacaaagaataaaccttataatatccaattaattttgataaaaagacgtgtttgaaacttatcctcagtatatttattaaaattctttatttcgaatatgatatgcttaattttcattctcatacataaataaatagataggaaccactaaagtggaatgaggtgtgatatcatcacaattatttttaataaattttttgacaagaaaaagttgtatctgattcttttaataaaaattcaacttataaaaaatattgtgtttaaaaaaagaacatacaaaattaaatgttttgacccattgatccatctcaattcaaattgtttacaaacagattggtttggattgagtttcacttttttcttaaaaaaaacccaaaccaacccgattaaatttgattgggttggatcatgaatttgatcaaattcaatccaaaccgactcacttatacccctaattaagatcataaatatcataatctattttcaccgtgaccaacggctatagggtatccgtagataaaaatacgatagccagcaaaatagaacagtataaaattcaacaagcaactaatctcgatacacttttccccttccatgtcagcatggattacaacttgcttttctctccactcaacagaagcagtaaagtcaaggagctcttctaaaaatacctattggtaatgtgtgtatatatatatatatatatatatatatatatatatatatataaaatggacctaactgcctgtttctgttgccatttttcgtttatgtgacctcttccttttcctacttctcttcactgtgttgtcttcactcgtttcctgcataagaaccgcaattaataaacatctaacaaatatttaggaaacaaagtttattttcagaggattgtaaaattaaataaaatatataacaccgtcgctgaaaaaacaaaaattttactaaccctaccttcaaaggaccaatattttgtttttcacttttcttcttcttgcatgaaagtgggttcggaccctgcaaagtttaaaagcagtatcataaaaatatgagaattctaaatggaaatcataagctgcaaaaagtaataaagctttactcaagactaatgtcaaatttaagttcacttgtaaattaactaggacatctttctacacaaaatgcatccaaaactgcacacacacacacacacacacacattacaaagaaattaattgtttgcataaacgtttcaagtctatataaacaattaaccactgaatatggtaaccaaactcaagctaggaaacagatacagcacaagggtaaattataaccttagctctttttctcttgaactgaggtttatccttgatttccatacgattccttgtagtaatacccttctctactgcctgcacatttatggtctgatcttctgaatcctcaatttcctttatttcagtaatggaattgctggcttcctcaccagtcaatctattcattaccctatccttaaatatcttgtactccttctgtgtcatgtgcaatcgtccttcttcagaagttttgacatattgccgctgaaatgcagatggagattcaaggaaaagagcatttctaagaccaaatatgagaggcacaccaggtacctgcaatatgcagattaagaagaataaatgtgtgtctaagtgtacaattctacacatcttgcatcattatgaaagcacttcaaattttagacataaagaaccagaagttctcattttttttttccttttaatgggaaaagcaccatactcaatcagaaaatgtcaaaaggagtgcataaaggacacatagtaaggtaagtcactaatggcacaaataggaaccctggctgtactgaaaaatgaaacacaaccatttacaattttgtatgtaacaaaccagaaatggaaggaacatgggatagacatcaagacatgaagatgttaaagaattttgtattcaaccactctaacaagaaataactactagaaatgctctacacttccatctagccataatcaaccatgagacaagaagctggacggattatccattgaaagctagcagatgcctcaatcagtaacaccaagttggaagataattcacacatttaggcaagttgatgcaaccacaatgggatgaataggattagaaatgggaagatgatacaactggattagaatatagaaggtgtttactgacaaaatctatatcaatgaatctgtattaaatagaatgaaagatatgaaatgagagtatgaagatacaaagataatgcagatgcactaaacaagatactgtctccttgtttccccacaattcaaccatagcaactattttaaaaaactgctttaattctggtctaaccagaagttccatattcaaaatgctagactggacaatacacaaattctccaagattgttatttaactgccaattaaatgacaagatcatcaattgcactagaatacatcaatcagtaacccatcttccacagatagcaacatcaaattgatgctccattcaaatccaccacgtctcgctaaccaaggttttgagataaatggctttgctcagttaatgagtttcaacaagctttaggtgttataacagaatgaaaagatacctgtaacaactatctttcagagtatcaatataaatctttttttaaataatcataataagtttgctaccaagaacctaatatcaagacaaatgtattctgagtccaaatagatagaagtgattctttcaggctggatatcattaaaaaaatatagttcgttaattaaacaaattttaccacgattacaaagaaaatattaaagagaaagacatatctaaccattagaatcaacatttaaaatatatatatatatatatatatatatatatattatacatatgtaacaaacctcttgcaactttttccgcaggtcagtgtcctgactagcaacaaagaaatgctcagaatttttttctccaacaacctccatgatgcaagcatctgcgctcttacatttttcatgctcacatctgcaaattggagtaaaatcaaggtaatgatcatttccacagcaataccagcgctcaaatatctcaaaaccctaataaacaaacaacaatgatcctgactagtagtccccttaaagactatcagatgctgattattaggactaaaaatacaacattgcttcaaattagtgagccttttaacataacattccgctcaaaatcataaaaaaataacattaaaatagtcatgtatgaccagttccgtctgaattttaaatatacaaaatacacactgatcaaagagtatcgaactatcaacaataacaagctatgtactctggttctggttatttgatttggcatcattcatgtatatagtattgaaactagtaaagttgaggaaagaatccatttaacagcatatgtacccagcagtaaagtgaattaccttgcaactataagtttatgagctgcctcaagagcctcagaatacgagctaccaagtcgtttcaactcagctagaacgcatctgcatcatctccacccaaaccccaaattaacaaagagaaataaaaaacaaaaggtatccaaaacaaaacaaatcacaattcatagttcataccaacgatgttgagctaagaaaaaaatgttaataaatctactttaaacatagagagggggaaaaaaaaggacctcgttgtgtacagcttgaccgtagcactgaggacattgccaatggccgtgtcagcaggggttattcgattcacaagaaggtgatgcacaaatgtgccatcacatagaaccttgtaaggcttccgaaaaccgaagcaagcagtgtaaaacgtcaaaatcttcctgtgcctcttttgctttttcaccttcatctgcaacaatgcataacaacacaatctgatgaaaatgcagaaacaggaattagctcggaaatttaatcggcattagaccattcaactttttcataaacgccaatcatataatctgatttcattcagaaccacaaccaccatatttggtaaaataaaatttcacatatgatagattgatcaatgatggagtaaagatgaagagaaattaacattagtttggcatatactttataccgtcgaccacagagccacggcagagcagctgtgcgcagcggagacttaaggttagggttgccagtgagaaaaggaacgggggacgaagctgtgccgcctgtacgagggtgcgtaagttaaaacttatcccacactatgctaggttgatttgattccttaaaattatgatattacacagatcaaaaagaacaatgcacacggaataaatacataaattacagtataatttttttatcttatatattatttgacgaataatatataaataaataaaataaagtatattaaaatatttaatattaatcatcttaataaagtttatataattattaaaatagagatagagggattgaaataaataagattttatgtttttttaaataatttcgttagttaattattgtttttattattaaatagataaaaatagagatattatctttttttaatatgttatatatgtataattttatgagtaacaaaatatagatattttttctctttaaaaaattagatatttaatctcatcctcatctatttgatttgtgttattttctaatccttttttcaaataaaatatggaacacccataatttttaataaatcaaatgaactcttaatgttattttaattaacttaatattaaatattaatatattgttttttaccaaaataatattttttatgttgtgttcttatactatatctttaatttaattttatatttatgttagtcatcgagtaaatctaaagtttataaagcctaattgactcattaagtgagtggagttaaaaaggcttttttttatttaaaacatcttatttagagtccaaagtcgtgttatttgcaagatagttaaatcgattcgttttgcaaactctaacaataatggaagatgatttttttcttcaaaattcgagaaaagagggagaagacacaagcaatgacaaaaaggtgagtaagaaattataacctagtcgtgaaaggcagtaatcaacctcaaaatagatttttcaaacaaatatacacatatcttagttcaaaaaaggaaaaattcatattaatacgaatatcattgagcatgtgcggacagaaacaagaaaatttggccttttcccctttagggcacattttttttatttatttaccaattgaggacaagttcttaaaaaatttcgaattaggggtaagtcgtgtcacgtgtcatgattttttttttttaaataaaaattggttgctaaaatttaatagctaatttcgatgcctaacattttttgcgataaaatattgtgattttttttttgttttttatgtgtaatcataatattatgtcgcaaaaagtgttagagatggaagtagaggcagaaattagagaccaatttttttttttaaaaaaagggagtcatgacacatggcacgtattttttccaatcgaatttttttttaaaacttgtccccaattgataaataaaaaaaattgcccccttttagaaaaaaaaaaccaaagaattgcctatatccacacccgactaaagataaaatgcagctttcgacgtttcagattctttctctcactcacacacacaagtaacattttattatgaaaaggaggcatctgtaccagaacatgagggaaaacaagtcttcaatcaaaactagctataactcgatcaatttttttcctctcgtgccctccattgtgagtgttttttctccaactgaataagccaccaatggtctccaaatataagagaccacaaaagttcatcatattgcccatcataatggccttaaacacatgaaaaaaactacctaccacttctgaaggggcattttgagaagatagtcccaaaaattagctttagcagtaggagcaggggaagcacaaatgttgagcaattccactccacgttaattttttcaaggaaaaagttattattgcttgcagatgttgatcaacgagattaaaagagatctcatataatggtgaaactatccaaatcacactaaaatgtccatttgctttttgagaggaaaatagctctaaaatccaatgcctcccaattattcttaacacaaaaaagggcgtgagtctcgtagaggaaaaacaaatggaattgtatgtaatttaactatgtccttaacatgaccccaagtggtatgacccacggctccattagctcattgaatatgaaaatcttaagaaatatccatagagacaaataggagaagacgtgggatcacaatcttgaaacccgtagagaaatcaggggtttgagagtattaatatcctacatatgttgtggatctgtatcattattagtaataagatcatcatgtgtcattgtatattgcacatttgaatctgccttcatattctttgtagacgttgcaccattaccgaatttaaaaaaattatttgactttgtgtgtgccttgaatccaacacttaaaatgattggcctttatatgtagtaaaccctttgggagtgggtctttactgattttggtttttctcactcttatatgatgttaattaatgttttttctgtgttttaggatcccttctcttactgtttgttggatccattttttttacgttgcacaaatatccagtcaccatcaaagaatccattacaacattaactatggaattaactctattgttcccttgtgtggtaccgactggtgtaattgcttcctcgactaaggttttcgacgctagttgcctaggaatgtaatgtactaccaccatggaataggaattagcgtcagccgaagaaagtgaaggaggaatttcctatgatgaaactttgccatctttggagaaatgtacatagcatcaataattataacatattctgtgcaattcttcatattcaatcttgtataagtggcgttgcagtcacacctaccactgaaacaattaagtcaatctctacacaaacataagcaaacctcccacgtataacatcaatagaattaacataaactttaattggctttctcactccaactactagagcaagtaaaatacattcgttacaaaagaaaatatttaaactaggaaaccttactcgaacaatattttccataatttttacttttgatgaaaaagaaaaaaggagaccatgtttcaactgatagataaccatcaaatatcattcatagttcctcctccttcataactttatttctatccatctcctcatcaaacttgatcataaagaaaccatggtcaacgtccatcaaagcaaaaccaacaatcaacttccatacctaagaaagacgatcattcatgggagtaaatccaatactctttcccaatgatttcataattagtgcatcctgccaaggggagcacagtgctataattttttttttattttttgaaattcgtggaattatttccctaatgtctagcgcaaaatcaaacactgatgcgtaaaaaaaaaaaaaaacagaaaaatctttttctcaaaactttgccgcgtttattgtaatgttcttttttttcattccctccacgtccgctcgaaccaaatggtactaaaatccaccccccgtagcgcacggcttatccttcgcaccccgaaacccattaaacgaaaaacagaacgctccaacttcaactttgctactccattgtcactgaactttctctgaggtactctctagctactcacatcaactcctgtaaattcttcacatgtttctgcttctctttcatcttcgctctgcaatttcttttttccctctcagtgtttttgaaattcgtttgaaaccctaacactatctacgagattggttttacctggatttcctattctcatacttgattctcagcagaaaacgtgaagacactcttcatatcccgattttgacctagaaatttcatagctatagtgtgttttctggtttgaaatccaaattgccttgtttattagactgtttttgaaactgaaactgcttagggaatccggttttttcatctctgactttgcaatagctaaagtagcttcctctggatatgctcaattgtatttatttttgaatttttgaattctgttgtgatagtaccttgtcttctgttttacaaatacactattgctgaaacttgagatagcatgtacaatactctgtgttgtgtttctaatgcgttcattcgtatggatttttttttttttctcttataggtacggttatgatactttcaacatgtacatcaagcaggtaattgcactttggagttatttatttaattaatttaatcttgttaatttctgcctagtcctaaattattagatctggctagattgcgtttatgtattatgattcataaacactttctctctttcaaacaccatataatatgctgttattccggttttggattttggagttggttctttgccattttttttaatgtacttgttttgtgtgcttttaggttgtgattgaaggttttaagagttatcgagagcaaattgccactgagcctttcagttctaaagttaattgtgttggtaataattttactgaaaagcttttaaatgctttcttatattgatactggaaaatcctttgaaatgcatgcgtgatgtgggcatttcattcatgacatgttatgatggcagctaaacaaagaatgaaattgaggcaatgaagaataagttgtttagtcaatttttatttgaattcagatatatttgcatagactacatacatatattcttgaaaatcttgccattgatctcctaccataacaccaattaactgcaatatctacattctacacatttccatagagtagtaccctacttatcttttcaaaacctttaaatagctatatataggtccatcatctgaactatgtaggatatgcttgctagtctagtaaagattaatggataactaagaaagtgcttcattaagattgtggttctgagtaaaccatatttattaattctattgattattgttattcaaaatccaaatgaaagactttgccttggaacttgaaagtcaccttttcagttccattaatgtccataaaaagaagagttaaggagacagaagaattttactgtgaaattgaaaaccatggtatgatctcatcctgcttgattgctatgctgataggtttgttctcacatcaagctaaaggctgcatacatttttttttggcagatctgcattctttactcactacattgtcttcagtttcattgcttccttttttccttgttttcactctaatgcattcttcctttctcttaattacatttcatttaatgttaagttgtttctaaagatgaatttcaatctttttgtttagatcaaatgatgaatgcatctgaattgtatttgtatgtaacttcaataatatctattcaattatttatttttgcagttggtgctaatggatctggaaagacaaactttttccatggtaagaaatcaccatatcttcttcgtctcaactttatttactgactgccattagtcttcggaagtaactgaaatcatatctctgaccttcaattggtacaccctttcttttgcagccatccgttttgtgttaagtgatctctttcaaaacctacgcggtgaagataggcaggcactactccatgtatggcacagttcatccatttatttatattctggttctcacctataactaatcagttatagaatttgaatatgcttaaataaatttttctctgcacaggaaggagctggacatcaggttttatctgcgtttgtggagattgtgtttgataattcagacaatcgtatcccggtaatatgttgaggataataatttttcttctattcgctattcactgttattaaaacgaaatgctatttatccttttttgttcataaagtgtattcctaaatggtgacaaaaatgggacttttttggcacttatctttctcaattctcagtgaaaggatagattgtctaaaagctgttatagggcatatgcacatgaattggattctacaaaacagtcaccttttttgccatttttaatctatggtacctttttgactggtcaatggttgaatatttatccattcttgtgcaatgaatgcatattgtgatcacgctgcttacagaaatgagtttgtaggcaaagaaaagaatataatagcagataaattttgtatttaactgaatgaagacttaatatctagatttgtataatgttttttcctcttttcactcaacgtcatttttaagttgtttgttctctatgttggataaacatcttttcattccatttttgaaagtctttggcattgagattctgatggtgcgaattttctgctagctggtaaataatttgattaatgatgaagtgctttgcattgttttgatttcactgaacttctaccatacaatttcaatttttataaaactattttatgccgaaagcaaaatcttgttattggtgcttgttgatgtaattaataattgcatgtcttcataattgatttctttgtactttctttatgacaacaaaattgctttatgtttgaaaatcacttatgcatgaaattcttaactatgcactatctgtgttggtgaataggttgacaaggaggaagtgcgcttgcgccggactataggtttcaaaaaggatgagtattttctagatggaaagcacataacgtgagtgaaatagaattacatgttagagcatatactttgcatttatttttcacttcaaaaaaaatgtcttcttttattgtatgctgtttggttgtatgagtatttaccttgatcctaaagatcatgtacaacctgcagaaaaactgaagtgatgaatttgctggagagtgctgggttctcccgatcaaatccttattatgttgtacaacaaggaaaggtattggctgatggtgacagtgcttgaacttggttttggatttatgttatatttataaactttgaatctaatatgtaaacctgtttcatttttactattgcatagatagcatcactaaccttgatgaaagactctgaacgacttgacttgctgaaggaaataggtggtactggagtttatgaggagagacgtcgtgaaagtttgaaaataatgcatgaaactggcaagtttatgatttatttatttttaagttcatgatttatctagtatttcctatttatttgttattcatttaagttcattatttgtaatctacatataatactaaagttcttctactaaagttacctcatgatattttctctttaagttcttttaatttattacgtcacttataatttatacttgcaagtcttaaaacaaaaataatatttgaaaaatatttatttaatttagtttttataatttttattaataatacttaaaatttgtttatatttgtatacattgagttaaaaagtgctattaaatacttcatcttgatatggatagggttgaaatacaataaattacactatacgggaaattgaatagtgtgctagtcaaaatataagacatttttgaaaaggaagatgttgtgataaacaagtttttaagaaccctcgtcctgagactggattgtagtcaaatgatgtataaaacttatttttccgtgaaaattttgtgtgcaaagtgtgtcaataatagactttgaaatactttcattagttaaagaagagcagtaaaaatacttcgttttatatttgttcactcaatctggggtacgttcaattttcctttaccaatcagtaaagggttccactaataaaacttggttacaacaagtattcttttatgtcatttctagcttacaagtattctcgaggtcactattggtacaacccttagactcccactaaatctaagaacatccaagtagcattgttctgtcactaagtcactcctgactttcacaaacaaaagtttggtatagaatcaaagtcttcacaacacttaatcgagtgagtttctaatccctcactagtactttgtatattacaaagaatggactctcttaagctcagtgtatgtctcaacaaatgattttcttttctcttatttcttgattcatgattattgtttttctatagatgttcgtcaaggttcttcaatccttgatgttgtatttataggtagagagacgctcgtaattatggagggaatttttgggatttatagaacaattggtgacttattggtcatgagttcgaatcctgaaacaacctctttgcatatgcaagggtaagactgagacaatatccctcctccttaccttcgcatagcgaggggtctctgggcaatggggtatgtaattttttatattatatagattattagacctgcaatgttatatagagctaaatgttagccaacacaggcaacatgatcataacatatggatagcagaaatgaggatgttaaggtgaatgtgtgactattcgaagatgaataagataaaaaatgaagatttttgactaaaggtagcagtagtactggtgagtaaaaagacgagggaacatagatttaggtggtttggacatgtaatgagacgacctttggatgctcccgtaagaacaaaagtttgttaccaagagctcgacataaagagaggtagaagtagaccgaaacttatctgaggaaaggtagttaaacaagacttaatggagtgagatatagattggtgaacggtgtgttttaggacagaatcgagaaaaactataagattggtggaaggttagatccattgctatctctatgttcaaaatgattcatttttagtcattttactcttcatctccctttttttttcaatctcctcgtatctatctttggatttatctatcatcgaccccaattaacttgggttaaaggtgttgttgtggatattgtgtggttttgtctgataggatcaagacttttcatatctgtcattcataattcaatatgaccgttagacatgtaaaaggaaataaaagatagattaataggtatgttccttttaaacaaaatcatataaactggaataaattgataaattgaattaagcattcttatctcaattggtgtttggatggactggacgagtacttcttgcttgaagtagacaaggtgtccattaatggataagtcttcaccttgtgttgcttctagttatcaaacctgttgatttacattaaaataaatattttccttaattttaaatttaaaagttgttaaaaatagttttaagtttatgactagatgagattaagaggaaacttattttcgttcaaattcttacttttaaattttctttgtatgaaattgaaattataataagtttttttatactgaatagtgtgtacttctaataagtctctctctctctctatcaataagtataaacaaactttataaacttgattttaatactttaactttatttcaaagatttaaatattaatttctccttctaatatttgcttaatattaatttaatcctctaaatatttgtgctatcaactccatccgatcaagcattaaaaggaattaaaaatattttgatttttaataattagataaaataattatttttttggttatttgggagactaatttgatattgtaaattttttaataactaatttaatatcaagtaaatttttaaggtactaaatagtagtttagtattttgtattttataataatctatttactaatatgtatattttaaaaaataacttaatattatctttattagtgaatgattaataacatgaaataaaatattttatatttcataaattcatgcatcacatcagtacagattctagtgtttattattcttgttattgatgttgttattgtcatgcatttttctgttagacaggtaataaaagaaagcaaataatccaagttgtacagtatttagatgaaaggttgaaggaactagatgaggagaaggaggaacttagaaaatatcagcagcttgacaagcaaagaaaatccttggaatatgctatttatagcaaagaagttcaagaagctcagcaaaaacttacagaggttatatgtgataaatgtttctctcttctataattatttgcatgatttcctactgtgttttgttagttggatttacttcttgatgattgggtagttagtcacaatcgttttggtgatgatatattcctttggttcttaaccttgctgtgtggttcaaaatcacagctatatcactggagttaagacagtgaaagtttaaataaattcttatgagtacctcacagatgttttcaattaatattctggtttggtttgattcaattgtctgtgatgtgagtgtactcagttttcatgaaaaacttcaaaagctgtataatataatttgttgaaggacaattagaaacaaaatatgccccccttttacaatttaatagctaattctagaacacattttaaggtgaaacggtcgtttctctttattttcattccgttttagttgatatccaacactgcataaatcagtagaagttttaaacctttttctgtttagaaattgaaattcctcatgtgctgaaccatattactaaatcacgctcaatagtgtcactgttgcactgcgttacccaactgctctccagtgtgctactcccctctttctctcttctgaccgagtctccattggaccccgtggtccatttgtaatcaactcgatacccttaactcctcttttcttgctataaatgtggataaaaggcctgtcatatactcgatgcaattatttggagtttataattgtacactttaatttctttgttgatcaatcataatattgaatgtcaaatatatattgttcagacatttttaatcccattgttgttatatattgggtttgtgatgcatgaagttgaatgcttatcaccttgttttagattgaagatgctcggaccaaggtttctgacacatcagcgaggaagtataatgatgttcttgatgcacatgagaaatccaaagatttagagaatacattaaaagatgtatcgaaagaacttcaaaactttaacaaagagaaagaggttattgaaaagcaacgaacagtggcattaaagaagcacacagagcttgagcttgatgtcaaagacttgcaagagaagatctctggaaatacccgagccaaagtactaatttgaagaattcatcttatgagttattttgttggaatggttttgtacatggctcatcttttacctacatgctttcaggaagatgctgcaagacaactggagatacttgagagagaaattcaagattcaactgctgaactgggcaaaattattcctttacatgaagatcaagttcagaaagaaaaagacattgccaagcagtaggttatggatatacttgtctttcaatatgcttcaattagtgtactgtatctaactctcccagtttatgtattcaaactttctgacatggtggttatgttttttactgcactcttataactggttaatcgtaattttttagtgtttctcatctagctataaatttggattagtcaggatgtaggatagttatatatatatatatatatatatatatatgtatgtatgtatatgttaatctttcacttgtttgtactgtttttgaaatttattctatcatttgttgaggatattcaacagattctaattagtatttctcccacaataaattaattgttagaataatggagcgtgagaagaaactcagtatactttatcaaaaacaaggacgtgcaacccagttttcaagtaaagcttctcgtgataagtggcttcaaaaggagattgatgatcttgaacgagtgcattcttcaaacaaggggcaggcaagtgttcatttatctgtagagctataatgaattatgtcctaaatactctttgaacagattcatggcatgaagatgtctgcttttctttaatcctgtgttccattaattttaaatgtgataactaaatcatctttctactctgttgtaacttgtatatgcattttttttcatgtttttctgcctaccagatcaagtgcgtgtctaactgggagaaatgatcacttacttttgtcaacttcctaaggtagattttggaaaataaaagtgattatttctgggaaaatagtcattcctaaacattcagagtgttattagaaaatagaatgaaagaagtacaatatcagaggatatggtttcccccatcgaagaaacaaaatgtgtgattgccactacaaacaatatcatctaagcttgtcattctcactgcatttcctattagagaactcataaaatattcttgttgtgtgatgtcgagcaacatgatgagaagactgtttttctatcagaattggcacatactctacttgtcaagttggattatttcctttttatacatttcttcattatctatgcttcatttctaattggcttccttccaaatactctagctcaatttggtcttgctgttgatttgtggaagctgcttgtagaagctaaggtttatgctctaatgaataaatgatataatcatatctcaaaaaaatcgtgagaatgttttggtgttagttgttttaatttttaaaagcaaaaggtggaagccagctaacttgtgattttgaagtctacttctcctatgaaaacaaaaaactgctctctaaaagtactaccaatttttaagagtccgtgagaattttacctgacacttgaatttttttgctcgttctttgaataaggagaaacctgttactaaacaatctcggactcagctgaatggaactttctatgctgcttattttaaaatgaactgggttatatttacattttacttgaatcccatatgttcgtaaagacgtagaccttaactattattaagccatatggtactcaacttgttaacattgatatatgagtattctttgagtatagaactttcatgtgatcagtgacccttgccatgggttccaatatttgcaaactgttaatctctgtctttgtattctcctgttataggggaacaatggtctcttgtactatgctctcttccttgtttttgattgttgttttggtctgcaggagcaaaagcttttggatgaaattgatcggcttaaagaagaactgcaggattgtgatgagaatataaacagacgtaaatcagaaattactgctttggaatctctcattgctcagtcacgtgaagggcttaatcattacaaagaagagagagacaagttacatggggagagaaagtatgtaactcctcttttgtctctttttttttaaaaagttctatgtagacttttactagatgaaagaagaaatattgttacagtgaagaatgtgtacaaaagtgtaggatggggtgccctccttagcaaaagtagaaaggagaaacatagtaaactgcaaaagtatattatttattactttccctggtcaagaaaatatttcttatgagtttaaattgctacattataggtccctatggggcaaagagaatgaacttacagctgaaattgataagctgagagctgaagttgagaaggctgaaaagagtcttgatcatgcaattcctggtgtaagtaatccctctttctaacttctttaacatctccttttgtaaatgccattaaattgtcaagaatcctcaacatggtgtttctaggcattgaatctttcactatggacggggtagtctgggcatgtttagtttagaattttattgcaacttatattctacctgatgtgaattaacacaaagtgccatcatatttgtaaatttgtgtcactctaaaagaatgtggatgattttgactatggcctttgagcgtttttacatttttctatgcagcatatagatgaaggagattgcagaaacactttaattccagaaattgtattacacttaaaatgatagaagatataaaattattttgttcggtggtggaagtacttttaatttttgaattggtaaatgagttattatatcataaattaaaatgagatagttcttaacacatcctgaattggtaaatacattatcatgaataaatttatgataataatattgatatgatagaagatatgataaatatataaagaacaaaagtttgttacccaaagctcgactcaaagagaggtagaagtagatcgaaacttacctggagaaaggtacttaagcaagacttaatggaataagatatagattgacagacgttgtgcttcggacggaatggagtaaagttataagtttggtggagagttagacccgttgttatctctatgttgtatatggtccttttttagttctttccctcttcatttccccccttctttgcttttactttttttttaacctcctcgtatctatcattcgattcatctactaccgatcccaattagcttgggttagaggtgttgttgatgttgataatctttataatttattacattacattactaaaagtgatcatttgttaactttattgaatttgattttatatttgctactcatacaattatatgtatattagattgtgtatgagttttgaaaatcatgctggtcaaaatatgttgtttgaataaagagatgatattttttaagtatacaactttacatgttatgaaatattttcattttttcaatacaaactgggtcatacaagtcaattagtgattgactgtgtcgattcgtgactcagtgacctagtagtacctagaccgagtcgatgaccagcccaagtttgataacattgggcacaggtacggagagagagttatgatataataataagttaacaaaaaatgaaatttattgaaactagtatcctggtacggcggtaaagttgtgccttggtgacttattggtcatgagtttgaatccggaaatagcctctttgcatatgcaagggtaagactgcgtacaatattcctccctcttaccttcacatagcaaggaacctctggacaatttgatacgtagtttttttttttagtagagcttttaatttcttttacgttgcactcaagccccaactccctttatgattgcatgatgtgtattgcaagttgtaactgatactacccaacaagtttcatggattgctgcattggaggtgtatgatcgcctgctccacattggacttgaatgtatataaatttgttattgtggaagtttacggtaatattttataattatatttgtaatcttttataaaaaatctttgaatagtattttaattgaattacagttgtatttttaatcaatatttttttgactatttagttgtagttaattataatgttggtaagtatgggtacctagataccccaatgggtaagggtggggattaaaattattatccaaaatagtatgagtcatggatacttagatcttatgctgctgtttatctgttgagtttgagggttaacggccatgatgtttctataatattattatcattcttgggacaggttgtttttatctatcaccatttttgacactattatgatgttcaggatgtgagaagagggttgaattcggttaggaagatctgcagggagtataacatttctggagttcatggtccaattattgagttgctgaattgtgatgaaaagtttttcaccgctgttgaagttactgcagcaaacaggtcatctctctgatatttcttttaatgtattgatttcatcacatgttgcattgagcattttcttatattgttttgggggaggggcaggagaatttggcacatcggttgttccatcttgttatttttagtctgttcttggcctgatttcattactggttttatatttttacacatttggcttaatgtttttatttaacatcttttgtttgaacagcttatttcatgtggttgttgaaaatgatgacaagtcaacccagataattagacatcttaattcacaaaaaggtggtcgagttacatttattccacttaacagagtaaaggctccacgtatcacttatccacagagttcggatgtcatacctcttttaaagaaattgaattttaaacatgactatactcccgcattcagtcaggttagcttctaaacaaatgttatcttttatttcaaatgggtacaacaacatctttatgtgctatttggtaataaaataattccgaggttttggtctatcagatatcaacttaacatgaaaaattgatgcataatggagaatcatgttaatttataataatcatgctattaaaggattattatttattgggtagggcttattatcatgtttttatcaaaagtttaaaatcttctcttattttagagatctcccctattcttgagaaacaagaaaaccattattcattgcatttatgactcatgtagacatattacgaataagagcctccgctgtgtaaattagacacagaattcatgtttcttgttttctctcttccttaaaagtttctaaactactgtaacacagcacaaggatctagtgggcaggccttattacctatgaacctgcttcaggttgtttgtactgatcctgattttgcttcaattagactcgtctcttcccgtgttatggattctcactagataaacatcctgttgggatatttactagattcatacactccatctatatagggatgaaaatttgaaattgaaggtattactgtgtaacgtgtatatttcaaaacaaggggggagatctgtgttatgttcaaattcaaatttcgcacaggagttcactagaaaattttcaatgtaaacacagtaattaacagagctgtcaatagtggccggagtggccactatcgcagcagagcgacagtgacgtgtgatgtagacttcatgttgcgttttagagttgcggttggagtggctgcgatcgtgcttctgactatgaagcccaagtgaaacccgccatgctagatactctgcgacctcccttgtgccgtcgccgaccacccactcttccattttcgttctctaacagggacgattcattttcacagtggcggcatgagctaacaaagaaatggttagtgatgggtcaggtccttagggttttagccttttagggtgttttttcttcttcttttttctaatctgttgggccccgggcctcaagtccaacatttctctgccatataatttcacaagggtgggtttttaacttgttatctggtgatctgttatctttgctataatataataaactaaataataataataataaaaattataatactattaaaaaaataaaaaactatttagagcatagcacataatataataaacttaataaagcgtaacatatgataataaattaaaaattgcagtaataaaaaacataatcaactaactaataatagttataaaactaaataaaacataatatataatataataagctaaatactaataataataaattctgaataatataataataagaaatatatattaaataagatggaaattaataatgaggaatcaactatatgtagaaaatggataattttaatttatttttaatgttttagtaaataagatgtttgccgttgatgtgatggcgaatctattatgtctttcgttgatgctttagtttgtgcaaaaggttggctgagtaaattagacttgtgcttatgagatagacaagacatttcagttgaacacctttatagaaaattattttgtgagattcattgaatgggattttcttagaaggtaatgttgttctgcttctttgtttcaagttggaatcttagatttacatttgcatatgctaatgtagtaaaaataatttggtgatagtagattattaaatattaattctttagttgcatttgatgtcccttaacttgtgatatttcataggtctttgctagaacagttatctgcaagaatttggatgtggcttcaagggttgctcgttctgatggtctggactgcataacgctggatggttggcctagttcttttcattgtctgtctacttgatctgggctggtcttgtgtttttccctgacaaattgtttgacttattacaggtgatcaagtaagcaagaaaggcagtatgactggaggattttatgatcatagacgatcaagattgaggtttatgaatatcattaagcagaatgcagacactattcacatcagagaggaggaattggagaaagttagatttaatctacaagatatcctttatgttaataaatgaatattctttttttagttttcatttctcttaggcaaaaactcattataaagtgcatataaaacatgaggaaataaaggaaagaaaatccagatgatctgcttgttggaagaaaatagctccaagagtgaggataaaggaaactttagatgtgttcactttttgttataatgcatatttgatatttcttcgattaattgcaactttacccctctaattttactagtgtgctggctaccttttcttgtttctcggggcatattcttgttgatgccttaaaagaatgttttaaacttttaatgagtaaaggtgcattgcttcataaaattgttttattagaaatgtgtcaagttgaagttaaagataatacgatgttctacctaggttttattgaggataaaacttttgtgttatagcatttgattgttccataatactgaagtccagtggttcttttggactctattatcgagggacttcgttattattttttcttgcatttgtttatttattgatgatgattggttttcctttggatgatttatttgctttatcttatgctaaaagtcttgtaagagactcaatttgttattgatctgacaacatgaaatgtcatatatttctctatttttgtgaatgacttctttgatgcctaagctattcctccaatggttgttttcactgaattagtcttacagatagaccaaaagattaatgaaattgttgctgaacagcagaagattgatgccaaatgtgctcatgacaaatctgtgattgaacagcttaagcaggatgttgctaatgctaataagcagaagctgttgatttctaaagcacttacaaaaaaggtgttattgaatttctcacttatacttaattatccccagggagctacttttggttggtagttgcttgtggagtttttcactacttttttaataccattttccttaattgcttgtaggagaagtctgttggggatgtccagaatcaaattgaacagcttaatgctagtatcgctatgaagaaagctgagatgggcactgagctcattgatcatttaacaccagaggaaaaaaagcttttgtcagatctgaaccctgaaatcaaagaccttaaagagaagcttgttgcttgcaagactgatcgtattgaggttatttaatcaattgtattggtgcttgtaatcttcataaagttggtgttcttattctggcttaaaattttgcagactgaagcacggagagcagagcttgataccaatctaaccactaaccttaggagaaggaaacaagagttggaggctgtaatatcatctgcggatgcagactctttggttgctgatgctgaatcaaaacggcaggaacttaatgatgctaaaatattggtcgatgatgcaacagggcagcttagaagtgagaccttcaaattttcaatcaatctagtcttttatctatatcttgaatatatttccttgtttaaccaaatattcttccccaggtgttactgaaagtataaatgaccgaacacggcaaattaaaaagatcaaagatgaattgaataaattgaaggtaataatgaccttataaattgctcacgggtatatgtattattgctcccaacaatgatgaaagcttttggctgtagtatttggaggacgagtatgaaaggaagcttcaggaagatgcaaaagaattagagcaattgcagagtaaaaaaaatacatatgctgctaaagaagaggaatatgccaagaaaataagggaactggggccattgacatcagatgcttttgaggcgtaagtctttctttcaccatttttttttgtgtgtattagatgaattattttagagggatatgaaaagaaaactgaaagatgctatgaaaagcattaaaggactcgacttctattagcaaaggaaaagtgacaattttctaccacattctatttgatattgtcaccttcttaactaagccttgtacttgtcagatattccaaacttctgcaatgatacattttcattgaacacatttgttctcactcctttgtcattaaatatggcatggctaactcctgcatccattcagacaaagcatgtgtccaagcatatgaacaggaaaataatcctatctccaacaattttggattgttttgttatttcggttatttttttaaattaatattaggtatttagtcttttttgggggtaaacttgattactgtgccatgatatgtttgatgatccgccagatatggtgctacagtgtatagcttgcagcattgaaatttatcattttctctgtactttgtttttagctaactttatttaattcctttcctttactcattgcaaatgccaggtatagacgaaggaatattaaagatttgcacaaaatgctgcacaggtgcaacgagcaattgcagcaattcagtcatgtaaacaagaaagcacttgaccagtatataaattttacagaacaacgagaagaacttcagaaaagacaggctgaacttgatgcaggagatgaggtactttgcagggattttcatttggaatgccctttattccccaaagaatcaaaagtctttgaggactacactgcttagcatatattgttagttctgcacttaactatctaaatgttttggtgcaactgatctgtcatggctctgaaagttgctttttatgtgcctctttagtaggtcttgttaaccaatcccctatatgtggaataacctaggaatgcttatgtctgatttgggttcaagcttgattttgcatgttggactgattccaatgcaactaatgtatcctacattgccatctcttttgacttattgtattgaataattacagcaaattaaggaactgatatcagtgctagatcaacggaaggacgagtcaatagaacgcactttcaaaggtgttgctaggcattttcgggaagtattttccgaacttgtgcagggggggcatggtcatctggttatgatgaaaaaaaaggtttgtgatcattcttgacttattgttaggattcaattgcaacgtatgagacttgaagtcccacattggaagcatgtgattctggtgtgggttttataaggccttgggctctccaactacaatagctagcttttgtggtgtggttctcccaaggttcttatcacgtttctattcagttcttttttgaatgagaaaaaatgttcataacttgttatcttggtttcacattttaaaatagttttaagtggacattattttcttaatgttttcatgtcctattgattccattctcttgtttgaatgtggtgcttaattattgctttatttccttgtattttgctaaaaagtgtaaggaatctccagcaaaaagtttttttagtcattgtaattgatatgaaagtggtatttctgtattttgtatttcctttccctcaggatggtgatcatgatgacgacgaagatgaggatggtcctcgtgaagcaaatcctgaggggagagtagaaaagtacattggagtgaaagtgaaggcaagtgtattctttttatgcctttatttttaattttaattttaatgtaaagtttctgccagaatgctcgagggtttgttaactacacctgttggaatgaggctattgttgtttgtttcggaatgcttgagggtttgttttgtacattaaaagagtcagataatagtgtggggtaggagatattttccttcatatctggagatatttttcctttctttcatttctggtttttatttagacttacgtaatgcaaccaatcaaaagcaaaactttatatcatgtaacactgcattaaaatagctgtgtcattcactggtcctttactgcagtttccccagcattgcttcaaaaaattagtgatttttatttctactattttacaagtacataacatagcatctaagttctgacatttctggacatttttatggcttgcaggtctcatttactggacaaggggagacacagtccatgaagcagttgtctgggggtcaaaaaactgttgtcgcccttacacttatctttgccatacagcgatgtgatccggctcccttttatctatttgatgagatcgatgcagcgctggatccacagtacagaactgctgttggaagtatcctttttatgcttgctatcatattatgtcaaatgtctggtcttgtgcaattcttccatctctatttactgcacacctcatcttccattaaatgaaattttatcgttcatattggaggtagtagaggtttaggttgatgttatatatggtgagtcttcaatcattgaaaacatacctgctattatgtacctatcacttaatgactcaactcaaaactgtgtggaatggaatgggatgggctgcaatgaaatggattgtttggatatttttatgatgagttgggaaaaaaatgtggttccgtcccatacccctcaaattggaggggaggaaaagtaggcggtattagggacagatggaatgcagtccattagattccatttcattgtatcctatcctatccaaacaatataacctaatattattccattccattatagtccgtacaatctcttttacatctcgtagattattttgaaaacatctaatgttattatatcttagattatccattacttagattatccattaaggttagttttcccgtcttattctctgtaaacattggtttccacttccttatcccatgatatttttcctagttatttaggattattaatttgattaatatagataagggtttgtgctttaggttttatgaacaatatcatcagttatatttcatatcaagtcaatataatatttagtctctgttctctccgttttggtggtctcaatgagacaaggcttttgttgttgttatggttgtacgagtttttggtgagatttaaatttaaaaattaattcatgcttgtgatattctttctgaatgatatatagatttcctattataccattgtcccttttggaattcttgatcttccatagatatgattcgtcgcttggctgacatagcaaacactcaatttattacaacaacattccgcccagagctagtgaaagttgctgataagatatatggagtaacacacaaaaacagggtcagccgtgttaatgttgtatccaaggaagatgctctggaatttattgagcatgaccagacgcacaatgctgctgaataaggtcaatgttataatttatatgatactttatggttgtgatgattcctactcgtatttggagtttttccttctcttattaactaacttgggctagtgcaaaattttgcgactctgtagatagaagttaaagtataattgttgcatgtttttcattgagaagttacaagatttttctgagcatcataggtataacttttttaggcaattgtttaaatgacccaatgatcatacacattttctaatgatatacttggtcagttggttataatttttgaagtggtattttttgtgttaggtgcttctgaatcacatggtctgaactgaaattagtcaactctgggactcttcgaagattgtgacgtagagattgcagaacctagttcattcaaattcttcaacctactatttatctgatgtgtagtgactggtgtgatgccaaccgaagtcttggagtaaccaaaaagcttggtcggatatgttttcaaagttgaaaaatgatctagtccccctcattgtacaaatgtaatcactttgtgtagtgttttagatttgttattttccattttatagtttataccaaaaaagtatcatgagtactttatctctttaaatgtaacaatacaacttgactgaaatttatttaggtttaatatggtttttggatatagaatattttagaaaagaaaataaaatctttcagaaaattatatatatatatatatatatatatatattgtataaatgttatttatttgcatccttagttaacctatagctgattaataaataaataatttaatttaatcagttaactttttactattaattattgcttatgtaaagatattggtggatatgcgtggaaatttttcagggtcaagtaaattattggttaaataatatataattaacaaaatttaattaatgtatttctggaacatgcctcacatggctaataaatatttctattagaattttatcataattacgataactagttctaaattcttaatttccaaaagaaataatcattggtttattattcaatagttgtaagttgcaatagttatataagtgaatcgtgattcaatgaactattttgaatcctagataaaagaactttatatccaaaagaaaataaaaaatataatgaaaattagataacccattgttttgttttagtttaaccttcttttatatttcgacatagaaactagaaatatatttcgtcatgagagaatatagagaacctaagtccatatcaacaaaatatagagatatgcttttaagaatttctcacgtcagttaaaattttcttgagtgtcacatattataatggacaaattttctaccatgtcacatatataatagacaaattttctctcattcttatcttattgaaatttaattttaaacaataaaaagttaaaatgattaaattttaataaaagatttaataattttgtctaaaataaaataaaatatttaataataaattagaaattttaannnnnnnnnnnnnnnttttttttttttttttttaataaaaaaatagtactagtaccaataatagctaacccaacaatcttccgaaaaggctaagcccaacagcgtaccacaacaccagttaggcgccgtctagccggaatcaccgtatctgtggtgatcgcacgttaaaattcttgaaatctaaaacccttcgttctcttcatttcacaggtatgcttctatacacagacacttaatcttgtctcaataattatctgccatgcatgatagcccaccacactgacttcattttacgtgtttgataaaatgcctgagttgtgtgaatcgtgtttacgttagctggttctgtgtttttgcgtgcccggaaccagccactgttaccctttgggttcaagtttggattttgtgcataggggtcattgggttacttcaattccctccctttttcctccttattggtttcacccgtttgcgttggtaggaactaagaagtctgtttccaattcacccaattttcttatgttaattcaatagtttgagttttcatgcgtattgctatgcacatcatgtgaagatttgtttgtagagtacgaattgctttctaacgtatttttatttattttttgctggtttttattggataaggagatgtataataatcagtttatacattattttcctttttaactattattaataaactatgcttccttgtgtgttgtgcttattgttgggagcctggcagtggtggcttacatatagggctgatttatttatgtgttgttttctgagtcttgactagccctttgaagtttgaactgtagcaaaacagtagggaagaaactgaaaattggtataaagtgagatactgagagcactttttgttaattatcgcctgtctatcatgaaataatgtatagtacaacagtgatacttgatattttccttttatgtgggagagaacatatgctttatcttcgtgcaatttttgtgtctttgcttggggtgggcatggttatagagcaatgtctgatgaatgataatagggggtggtgattttcttttacttcacccttggtttgtgatttggtgaaactgtgttttgcagagtagaaagaacaaagaggagaaaatgaacaaggataagatcttcaagctagcaaaggggttcaggggtagagccaagaattgcataaggatagcaagggagagggttgagaaggccttgcaatactcctacagagaccgccgtaacaaaaagagggacatgcgatccctttggatccaaaggatcaatgctggcacccgcattcatggggtatgtcttctaactccttttcttctctcactaatccataatattttcaattcaatacttgaccaagaaattcaatattgctattgttgttttcatcaaactttgattgttgaccaagtttatttggttttctgctgagtaagagcctaaagtatgtttattagaaaataaccagttatttcttttgcgttagtttatgaatttgtgctaacaggaaaccaatcatactctaaaatcttggtgatgcaattgttatgattgtgaaccttgtggtaactctttcatatgcatgtctaacttggcaatgtctccacttgaaagctctcaaagcaaacccatgctttatatatttaaattattgctcctttaaataaggagcatggggaatatatagtcacattgtagttccgttccgatatccaaaggaaaatttctcatatgttgtgatgctacctacaaatctgagattctttgctttagcattgtctggaaactcaggactgacttccccaatcttcagttgggtttagttttctcctattaatgcataatttatttgtgtaatagctttcaatgagttccccctttccctaatcatatcatgtatccggtatcctcaaaactggaaggtccttttgttgcctatcttacaaaagtaagaccaagcaacttctattgttctcttgtcattgctttcagttataagctcagtaggatgtgagcttctaatggtaaatggtagaagtgaatttgtattctttattaagaagcataggagaatgtggatgagcaaaccagtaatttttttatattcagagatggattttgtctgtttgatgtgtgataagagaagaagccatgaaagtgaaaatgagtctttgaagcaaaatagctttcttggaagaaagattggattcttaggtgaactgtgaacatgcacctggattcaagctaactatatttcttgttctaaaatgactatgaactgaatgcatggtgtgtgcgagtgatacactttagcctcaaatggattgaatattaggtgaacctccctctggaatctgtaatttttctcatttatttaacacctctattgttccttttatttttgagtttatattttcatggacatattcttcttccattttctttgtcaataaacttttccttttatttgccaggtcaactatgggaacttcatgcatgggctgatgaaggagaatatccaacttaacagaaaggttctgtcagagatatctatgcatgaaccctatagcttcaagtctttggtagatatatcacgaaatgcatttcccggaaacaagaatgtggtggttcctcctagaaaggtggccttttagagcatgtggcacttagcgaacatttagtggtagtttatgttaaaatcgtgaactatctttgaggaattgggtgtagtacactatatattgctatcaattttgtatgcttgttattcccaaacttgtgtactttgtaactacatgatcttacccctccgctacctctttcaattgctttggtgtcagaaacattgtacaataataaaccttgatcccaactacgatcaattttatggatcattggctgccattagcctctataaaaaaataaagattttttttaatatatgttaaaattgggaagaacagttgtctctgaggttaccaaaccaattagaaagccaagtttataagataaaattgccaaggctccagcgtaaattttatttcaaatagcgtgcttcttttctagtgctaaatggagtttctctaacgctttcattacaaaggtacacgtgtaaatcaattgtgagtctcattgtagaaaacgaaccgtgagacctttgggtaatctcattaatggttttagtacttggtggggtttgtagataacccaaatccaaatggaaatagaggatcataatatttatcgccaacattcattgggagctggtcaactgtcttgaaccatgttcttgccaacttgccagtgaatccgtagtcaccaaagagaagatcagttacaccttggccttcagtccctggaagccatgcagccacaagtgcgtctatttttgatagatatggctgaatcacaactggtcggccggtgatgagaactaccacacattgtatagacccacatacattggtgatggagcttggacctggctctggtatagtcaggttcaaactatcaccaaatgtttctgcataagggtgttcacctacaatgactatggcatatgagaagttgttggacttgacaaagttggagtcaggattttcattgtagacaactttagtagcaggatcaattgtttgttttacagcatcaaggattgttgtacctgcaaggaaaatggtatttttttttgtcaagtattttataagtatcctacaaaaaaaacttatgatcaaatatctcaagttgctgtgtatgagtggttttcatgttaacccatgtaggttttagtgtgtgattagttttcaattggtgcacgttccatagcatgttcaagtgaatccatggacgtggtgtcattggattcaatgtttgtttcatgcttttgaacggaaaaccaaacacacctttatggttcagagttgatgctttttaacatgtaatactaaatagtccctccaatagtatagagtttaagtacccttatatacgcactcctaagccacctgagagatttctacaaaggtagttttcagattaattttaaacacaccaaagttaagcatgttggcttaccgattgtgagattattgcccccaagcccctgccaggtaattgtccatcctccacattgataacccaaattgtcagcatgacttcctgccaccagtatttttgcagctttcttgggaaggggaagcagaggcttctcagcagatttaccattctttagcaacacaagtgatttccttacagcttcccttgctaactgtctatgctcctgtttaagacacaataattggtcaataaaataattctttccatttgaaagatatggtcgaaattacatccttgagaaaatatacctcactaccaagttggttcaccaggcttatatcagcatgaggattctcaaataggcccatgacaaattttactcttaagattcttctcacagcatcatcaatcctacttactggaataatattgttctttacttgataagtcaggacatcaatgaattcggtgaaattaaagggaaccatgatctgtaaaataatgtaaagtcataaactcataataaatgaaaagtcattacattaaattttagacactcaattcataatatttctttcttttgttaccatatcaattccagcaccaacaccaacttgaatagagtatgaatagttagaatgaggaggagaagtaatcctgtcaatgcctagccaatctgatatgacaaaaccctgaaagataccaaaaaataaacctaaggtacatcacaagctgcatgtttactcatcttcaatttgatggaagaccattttctgattttaaaaatagacttaattggcctaaaaagcaaaacttagaaaaccaaaatcgcacataattgaaagaaccaaaagtactcgtcaattgctttattggagaattaatcaaataagttttatttattaccctgaacttcagtttgttcttgaggtaatcagtgacaagaaaatgattagcatgcatcttttggccattccagctagagtaggagaccattactgttgaaacccccttgacaatggagtcatgatatgcaggcatgtgaattcgaagcaatccattataactgacaacagtattgttctcattaatgcccttggttgtgccaccatctcctacatagtgtttagcacaagctgcaaccttgttcctgtgtcaaagtaaataaaatgttgaaggtctatattgtaaccccaaaaaatgtgatttctaatacagcaaaggttaatcagcaacggctaataagataaagaaaaacgcttttacagttctttgttttctgtttctggctagaccatgtatactccaataacatctatacaaattaatataccttgcgctatatattagagacttttgaaattcggggttatggtatcccactcccacaataaggtttgccaataaatcaaatatatattttccaagtagaaactggtcatgtggcatgtaggtattaataaatatccggagaacattgactttcatcaaactaccaattccagaatgcagaagttcttttcttcattaactgaatatttaggcaagggtatagtgtctttatatttgaaacaatattcaagttttaatattttaaaacttatagaagtaaaagaacaaaatttgtacactgaaatccccgaagaataaaaaaaaggtaaaagattgtgtaaatacaatgcaatgcttttgcctaaaaaacacaaaaaatataaattgcagtaaatcttttaataattatcaattataaacaagaagtgaacaccaactgaatgactattaccatccaacatatgtgcatggaagtatatataaagtcaaggatgaccaattaatctaatgatttacattgaactcaatagctattttattttaattttgcagtgtaaagttacaacccagaatcttactttccagcgacaaagggaaccccctttctagaattgccactgatgtctccttgcaaaccaggaataatttcagtcattgcttgaacaatcttagggtcttcactatagctttcatagcaacgtccccatctaggatctctgcagacctgtggaagaataaggctatcaagtatcaacatagtaggacactagatcaatgttaaacttttatgtcatctagaaaaaataagaatcaacactttcttaattaccgcaatgcatggagcaaacacatattgaattccagtagctctaacttcaagggcagttgaatctccaatcttctttatcagcactggatccctatcagcattatataattatggctatttattcagttaagccgctagatagtgcaaacagataaaaaataataataattcattttaaagatctaaaaagtctcaataataaaatttgacagtccaatttgatttatctcttaatgaaggataattaattgaagggtctagtgataaatcaaatgttagcatattgaaatattcaactgcatataacagcatttgcatttgaaaaaccaaggtcttcatattacaagtaaataaaaaaagttaacatgactactatttgagtacatgtatacttgcctggtaactcctagcccaacattgtggggaaaaatggttgccttgtagacattattgtggccatgaactgcatctattccataaatcattggaatcccaaggcgggtagacaaagatccattttggatcccattcaccatttggatccaagtctcagcaggggcctttgtttctggaacactccctcccccactcagcacactccctgcccatcaatcatcacatcacttatatttctttaatatatgtcacctccataatagcaaacactgttatgccccttttgttatacaaatcacacacttagataaggaaaagaaaacattactaactattaagcatagtaaactatagcatagcatataaggcaccagtatttggttagagtttggatgagagcaatttaccaatgaagtacttcttcatcacttgaggggtggcaacacttcgttcaatctgcaccatttggcctatcttctcctccagggtcattcgcttcagcaagtccttgattctaacattcagtggctgttttgggtctttgtacttcaagtattctgcttgtgaaacagaaaccaggcagcaaaatagaagaaccaacacaaggggtgttgaaattgcccccatttgaacacttgaaagttgaacctgcatatagtgaaatattttcacaataggcatataatgttaatccctttaattgacatgcatatgaagcaagagaataacatgtcaatctgaatatacatgaaaatggagcatagttaaaggcataaaggaaaggttaccagtattctaggcactgaagtgaagtgaagaagttgaatggagtgtgaggagggagacaataaagtgggtttgagagtgaggtatgctaatttaagaaaacttttaaggtggtccaaaattattattatccctactccttaataatctttagttgtttatataatacataattaagtgttattattttttcaaataaattaaaagtaagtatatatgatgtagaaatagatcaagactatatacacagttccaaactatctaattaatgtagaaattaatcaagactatatacacatggagagtgagagcagctgtcagtgattggtcccagtacagttacagcctgtgcttctcaactacattcttatatatatatatatatatatatatgcatatgctgacattagttgtgtgaatcatatcattacctttcagtattaacgcactaatcataaatagtaaagaaagtttacttttcatgcaatctaactgtaagaatctttactctgttggattgggatatattgtgctgtagttgttaattatgtcttatggtaattgttctttttgtactggtggtactatagcttgcaaaatttgttggtgatgtatttactgctatattctgttgttagactatttcttgtgaactctaatatgttaataaaatatactttattgactgttataaaaactatcaattaattataaattatgttagatataacttttaagataatttttataaaaattaataaatttgcatgttataataaattggttggtagtttagaaaatagaaaccttaaaaccttctcattttacaccgtttacatttaaatgagtttaatattgtattatcatttaattataaattatcatttgaattttttaaaaataattattttaaaagttaataaatttattatacatgataggtttagatgattgcttaaattttttctcattcaattaaaacagattttcttttagtttattttattacgttgaagtttctgctcatgacttgctcctagatcctgcatttttattttttatttttttatttttccggagtaggtgagtgaagcaaggggggaatttagaacagaaaagctcgtgactttcaaattaaaatgcatgggcagcagtacgtacgttcgatcgatattgcatcatctaatacaatggtccgcaggatcgtaatactaaactaactttattttttctcccttagtttgggaaacatttcatatgttgtaattttgattgtatctaacatttttgtctatgcctacatcatgtttgtaagaagttaaaaaaatataaaaaatattgagggttttatattaagtaaaaaatcaattaaaaaaactgtaaaactaacataacaaatgcttaatttaaatttaaagaattaacaatgtaatgaaaccaaaaatttactgaacattttaagttgttacaaatttattgtgtttgtgtccctgttaattgaatacctctttattaagctactgaacatttgcctacaaatttattgtgtccactgttagattgtacgctgatactgacatgtttatatgtcttctcgccattcacaatttttgtatgcaaatgttgctttctgtttcagcggggacacaagtcatctcgtgatgtctagcttaataattcatacaaatccgaaatacaagaagagtatgtacttttttaatcaaaagtattgatgtagtcctataatgttttattgatgattgtatttatataagtgaaaataatttatttaatagaaaaatttatgaatcattgataagaaaacatcctgagaaaaaaaagtatgcaactaaaattttatataaccatttattattctttttatattcatcttaagaatataataaaagaaataattttgtattgtcctgactttacaaaccaaacattttccatttatcaaatcaaatttcaagcaacgtgccttttactttcccccctttattttacgaaacacaagtctatcatcattttatgggacctatcatcattttatgggacaagggacaacggtgtcatgcatgtacgtggcatattatttatggaggaaattcatcttgtaaacacgtgtctcttactctatttgacacattgcttatatttcatatcgtgcatatgcggcatcatattcaaattaatatggattaattttatcttgaaaaaaaaattagtacttacaaaataacaaattgcagtatgaaactctgtcggcagtgtttgtatttagaaactgaccatatctttctcataaataatgttcctgaaagaaatgataaactatttttaaaaatgtttattgaaatactcttttaaatactattatttatcattaagtgaattgtagtaaataatttagaaaattcttataaaaagaatcaagaagggcatcgaaggtccaacattttagagttaaggtgtaatataagaattagaagaattctactttcatgatacttttctataataaattttacaattaaagagatacaaaggaaaggaagagataagatacatgacgtgctggaaaaaacggaaaaaattgaattattaaaaagtgatgtaaaaaaattgatataacatatcattagagctagtttagtagtgagtgatttggatggtatacacaagactttagattctaaccttgtcgctaacaaaaaataaagtagatatattaatatcattgttgccaagttactaaactaagtttgttctaagaaaattatttagaaaacattttaagggccgatcgaaatgctctgcagtcatgaatttttactagcacttattaatttcctagatcttccacagtgtattttagaactgcaagaggtgcagtttaattaaaatatatagctgcaaacttcctaatttaatttggttaacaaaaaattatcttatgaaaaatgcattgctgatatgaatgaattcagccgcaccaaataaaaaccatataccaatttttataacgagcaatttatttttcttaaaacggtttggttaataattaaagcatgcttatgtggatgttagagcattcaagcaagatgcaagacacttttaactattttacttatacataactggagaacataactgtccagctagtccttttccttgctgcgaaaactacccagctgaaccagcttgtgtttcttattgcaaacaaaaatttaaaaaaaaattccactagcatgatcattatgtgaaataaaataaaagaaaaactccacttatttattttaccaaaaggaatgaaaattggatagaataagatcattcttccaacttatttaggatagtgagcaccattatgtccttcccatttcccatttcaagtatctttctacaatgtccagtccacagagttccttgaccacaggcatggttgcagggacccccaactgaaatgttgaatcttctccatcgtggttgctccatgaaagaagctgtttccttgcttcttttacagctgctcttgtggcacagtgaatggaagctgcaagaagtaatggcggctcgccagaagctgcagcaacaaatttcaaattttctttttcattttagattttcatactggaataagtgaagctttctcaatcttattaagagtcttaaataaaaggtttaaatacctttttagttattgcaaattactatttttttctctaattataagaacattttcagaaatttatttattcttttttataagatcatttgttaatttttagatgcattaatacttttatttaattattctctcttcaaatattaataaaaataattaaatgaatagagaaataaaaaatataattttgaaatgataatataaataattgacaaatttaatatttaatatgattaactaaattaattatttttgttagggatagggaggagggagtaatttcaagtttacagacacgattattttttttaccaaactattatgcagatgaaattgaattaatcattatgtgttccatccacttccatcctcaggcttgatatcgaactgtttttttttattttattttaaattttctgttccagaggtattacatgcatctcgtacccaagctcgtatattattatttaattagttactttccagtacaaaagatattgttaacaaatatttatgtctttatcatacctagattttgaaattgaactgttagaataaactataatgaatcaatgaaagagagtgcacaaaactactcatttcatgtataagtgaagtgcattcatgagaaaaaaataaataaataagaccgaccaatttcacaaacaggtttttgataactccttgctcataccttttgaagagagaacacgttgctggtggtgcccactgttgaggacttgaacgttaaactgtttaggtatagtgtctatcgtagggattttgtagttccaagtgccgtcttgcaacaccaaaccatcaagatttgtttcatattcttcaagcatgaaaaatcctaacccctggacaaaagctccttcaatctgcaggatacaattgtattgttaagaaggataaatattcatactgaaataactgaatagttgtaagtagtaagagaccataaacattctaggacccccaattaggagttgataattgtgttttccacttttactattaaatttaatttttggcatagggaatagtgtgccagttcaatgtccttttttactcccagagggtcttgatgtgagaagttgtgtaaataaaaactatttttgggcccaactcttgtgttattccttggtatgggctgagcttgcttagcaaatatgtagttggcttacctgtcctaaatccacagcagggtttagactctgtccacaatcataaataatatctgtttgcaaaaatctggtttctccattcagaagatctatttccacctgagaaataatttccaatatttagaatatcagtataaaaaaagttggctcaattacctcagtaacatggtttgtgtgaaaatatacattagcaattaacattcaagagaagtaattatcaaagaactagagaaaataccattttgatttgagatgtgcatataaaacaaaaaataaaactgacctacctcacttactgcagcaccataattaaggtaactcagagagttaatactgggtgcatacaatgaagatgctgataagttcacagcttgcatgtgtgcctgtacgttaataaattgtcagcaacatggtgattaaatataaatgcttgtgggctaggaaaataagaagaaattctctaccaattccatttgcacatgaaattccctgaatattttcctaattatagtaattatgaaccaataaattgtgagaacgctaattgccagtgtgccatcttccgcactacatactccaagaccttaacaggaaaagcttgaagcaatacatctcatgcacaattacaaatactaataataatatacatgcatcaatgtgaattgaaaaccacaagtttgtaaacctttcagtggtcagtagtgaaattcaatcataaatagtctgtccacatggatcataaagagagaaaacagttaagttgccacttgctgcatgttatgaagagaactggttttatcttctgggaacttcctcccacaacaatcatgaagataactcttttaagaggaaaatttatcaatgttcaaaattgagctcttttactttatttatagtagctacctgaagaataagggtctcccacttgatagagcccatttcctcctgcagcttttccttaagaggctttagcctctctaccaagatattacatgaaagcctaactgcttcgcagcttgactccgatgtagtgctcccagcagtgaagcctccttgagtcaagctcaccgtatcagattgcacaacccgtactttgtccaaaagaccttcagttccatcacattgaatagcaccgagaccatatgcagccatctgtttcacctttgtccaaagaccttgacccaattcaattcctccaacttcaacaacgacagacccatctaaaaaaatacttacttttccaggagttggtcttagagtcagttgaatcacaactggtactcgagaaattccccttttcttccaggtgttaatcctgttgaactcttgcaccaatttatttctctggtcatagtttgcagaaacagccaacttactccatattgaaggcaaagtatactcataaggttcaccatgatagtactcatagaatgactgaagacttttgtgtgtgtgaagattaacgcttctgacagaatctacatccattaaaagtgtagctgcaacattttctataatagcttcagctataaatgatccctgaacctccccagggcccctcattgcagatctacttggatgatttgttctgcataactttatatcaaaacatagtgcaccccagtcgtactttttaagtgcgtaaactatagcgtttggcataattgcacttacatccacatatattcctgcattgaccaatatctgaagttctagtgcagtaatcttaccatcattcctaaacccaacactgtaagttatcttcatgggatgccttcctccggccattatcatatctgtctttcgatttagatacattctaactgggcgctgtaatttctgtgctgctagtgcacatgatgtggcaacctgcatgatccaatggttagtattatagacagttagacaaatgcatgcatatgtaattttcatatataacttctctactactgaatcttttctgcaatcttacaggatgggttagaaaaagggagaagataaagcacattatattttgaaaatgaaggaaataaaaagacagaagtacaaaaccattttattctaattccaggcttgccgttgacaattatatcatgcaacatataatggaaagaagctacttatatggacatttcaagatgatgtgacatgacataagcttctatttataatccacaggagtaaacttcttttacaatttccagaaatttgtctaataagagcacatactaatatgtctacagaaatatggtgataagaaaagaaaaaaaattcagattatcggtgatacagaaaatttgaagcttcgtatctaccctctacattgaaaaaaagtgatagagatgagtaatatattagattttcaaaatattaaagcataactaaatacttacagatactgcttttatggcctttccaccaaaaccacccccaacccttcttgtaattacacgaacattattttcaggaattcctaggcatcttgctatagtagaatgcacaaactcagggcattggtttgaggagtagactgtaatgcaattgtcttcatctggaacagcaagtgcagtttgtgtctccatatagaaatagtattgagacccaagtttcaactgcatttaacattgaatttgatagataacaatgaatatttgttcagcataaccaattaaacattaattattcaggagcaaacttaaatattgcatcagaaaccaaggtttacaaaggaatggaatgagaggaagaggggaagcagagtaaataatgtacctcagcagaaagaatcttgtgatccgcttcagccattccttttgatatatcaccaacatgttttggataaagaaaaggaggaacttcaaaaaagctagatctttcaacagcatcttcaacggatagaataggtggttcaagattttcggtatcataatcaacaacagctgagtttgcagccatatctgcaagtttctgagtatctgcgacctaaagaaggtattcggtgactaaaatggtagtatttcacatatcaatctccaaagaaatgaaaaagaagctcatactttattggatcagaatgagggatataagaactcaccacaaaggctagtcgttcaccaacacatctggctatctcttcagcaaagagaggttcaaccccaaatatactcttagatccaatgttttccccaccattgggaatgtctttacttgaaatgatatccctcgatccatccaattgcaattcaggcgtgagttttatactcctaacccttgctaaaggttttgcactataaatatatgctccatgtaagcaatttgatggtgatggaatgtcatccacaaacacaacctcacctatacatgatgattattcataaatatgtacttgttactgaacaaaaatttaaaaaattaaacatgaaaagttataaatgacaggcaccaaaacaggataaaataaatctcacacacaaaatctagtctatggcctgcagtacaaagtggactttttagcgtagttatcttgacaatagttataaggtagccagagacaagatccaaaatatggatacgcaattcatcagaaccaagagcatggggaacaagttttttatgaacataggggttttgacttctgctatgtagcaattggtaataaaatgctactaaatgaatataccaacatggtgtgacgtggttggaagataatattgtcttttaagcatgtggtcaggtgtttgatccctggtccaagtatatggaaaaacatctgttgggagaggttagacccttaaatggatctacgtacctcgagggattagtccttggctctctgccgagggataccccggattcaaccaaaaaaaataccaaactgctccaaagcaagagatcactgttgggtactgaacaatcacacaacaatcaagataggagaaagtgagaaagggaagaagaaaacaacacacagaatttaccctggttcacccaatgtgggctacgtccagctattcactatatttcctcacacacttgtacaattgcactcagattacaaggaaatatataggcttagaaatcctaagcatcgtagctattcatgggcccaagcacaaactacaaataataaaacacgaggccaacaacaatactaggcctctagccccctagcccccgccgaggagactcccctgggcccccgtgcatatctactgatgacacaatttgagccatacctaacaatcacaggaagggaaaagggggaaggcttttagagagggaaaaatctgacacatttactagcttgttgctacaagcttctaaggagaaagagagacatatttttatgaacctgacaaagagattgatgtcacatattcagtggaagtgaataatgatgggcagtccaacacacaattcagcaagcattgtaggatctagagagggtaaaatgtatacaactgtataccaccagattacaagcttacaaccctaaaattgcacaaggactcactttctagcaaatggaatttaatacaaaaaagtaccaacttttttcatgtaaatatttaagtttagtactttgaaacaattatagaaatgcaaagacagaaggcagtcaatcaattcaaaactcaatgatacaaaacaaacctgaagcttgtagtgcagctccagatttcatgattggctcaccaacaggatgatagtcacagcctgcttcaaggatttgcttaccagatgacagtaaagttggaactttgtcatgacgaacctgcttctgattctcttttaactcaaaatccttagcataaggaagattaatatgtccattaaaataaccattgtttattgcggaagcgtcaagaagtgggttaaagaactgaaaaataaaagcagctgccaaacttgaacggtaagtggtttttgaggtatcatctttaggtacaatagtggctgtaaccaagatgacagcatcgtatagaatgctagcacttaaaagctttccagctaaaaactcctcaacattttttgctctgattgcatgcttacccccataagcaccaaaagacaacctacacgtgtcaatcacagttccaccagaatccttccattgagacaccttaaccaggaaagcagaatttaagtaagaaagggcatttccaaggggtcgaggagaagctcggtaagtttcaaagaggaatctacttcttggttctgataattcacttatattgagttccaaactaggaattttaatgctcaaaagcacactttccaaacctaatggaggtctttggagaaattcctctaatgttagccactcaaattgtgtaccagtcattatgtgaaccattgcatctacagcaagaagtattgtagcaatatctgagggaaaattattcttctgtgccataactaaatttccacctacactggctgtgttccgaatatatcctgaggcaactttgctcatatggtcagcaatcttttcaagtatcatcacataatctgagagaaagtcacttctgctctcttccttcagtgcttcaatagctttagatattgttactgctgctccaatttcaatccctgtttgatcctttctgatctttgaaagctcagaaattccccttagatcaatgtacttatcataggcttccttttctttgtaatatcccatacctgtattactaacaacaatttttatccgggttccattatcatggtttaatttcaataagctctgaagctccattagactaataggtctgtgccaactgtgtttctcagaagtcaagaatacatcatgcttgatttccttcaaaaacaaaggaaatctcctattcattttattacggtcatattgaggcaacctactaacctttaagtccttgctgtctccctttctccagaaagagttgaaccccaaatcctccatatcaacatcagctgcaaagcttttgcaaacatcagcaattggtcgatacccagtacagcgacaaagattccctgcaattgccttttcggcctcagcaacagttacttttgagaacccagcaggtggctctggacaagtaatcttttcagcattgacaagagttccaaagagggaaacacacattccaggagtacaaaagccacattgagtggcatggaatcctgaaaatctttcatgtattgggtggaatccttctttagaatttccaatgccttcactagttgttattgaacagccatgtatgctgcaaagtagtgtgagacaagagcttgctgtaaaatcctcaacttggtcaagcacaggatcgtatttggagattaaaactacacaagcgccacaaccccctgaaaccaaccaaccatgtctaaacatgaagtaccatgttgaaaaaataaaataaaaaataggactactaaaacacctccttcatcttcatgatttgagcatcagaaaaataagatgaattcccccgcctaaatatatagggtgcagatcaaattactccaagaaaaacacttggcagagttactccattcaataattctctctctctctctctcaacgattcattagattaaaagttttcattgaatagctcaagtttacaatttcttttagtttaaaaattatttagtacttctatccacgcatcctgttcaaccgagttattcaaccatcttagttagatcctttatgattgaaatgacattaaaatgtttatgggttggattgtggaaatctaacatatacaaaaagttatggagaccattaacactatcaagagttactcttgaagaacttacatgtataaatgaaaatgaaaattattgatatagctcaagaataataggaaccggtacagtacatgtttttttttttttgtttgacagaagtacagtacatgcttatgatcagcctaataatatactgatcgacatctaattcttccattgtatctgcttcttaaaacagccagaaaaggtgtattggacaattaaagtgacagtaagcataaagggagttcaattaagtgcaaaaattgaagcagcatcctacaaggtcacaacagctttgaactaatccgtttgacctggaactggaaaatcattccaagaccatcaagatttattcaggatttcaccaagtggaaccacaattaatcttacagagaaggaaggagaaagaagatgaatctatatcgtaaataccaagcttattgaaataggaaaaacaaaaaaagataaatggttgaacacaaacttatagtatataccttcaccacaaccgagcttgacactcttgaaacgagtacgagtgcgtaagaattggagcaaagtggttgaagggtcaacgtgggagagctcaaacctctcaccattaacaccaaaaaccaaacttgttggtggtgtcttctccagttccatagttcagccagtgttatttcgataagttttgatcagcaacagaagaaaactttaaactctcataattaatgtgtgcgagtcggcgttccttactgatctttcttcacatcaaaaaagtcaacagttctcgatcgacgtgggcaatgttaattttttcgaaacgcatgtggaattggtatcataatttccaattcattctgtcactgttacctcaaccactgtcacctcaaccagctaattcaacaaatactttattgattccttactctatatatgcactttctcacccacctttccatgctgctccatgcaaatgttaatttttttttatcaataaatattaatttattaaaatattaattttatctgaagaacaaaaaagatcaaattcgacaacctttttcttattttttaatcatccaactcactttaaatttctaaacaaaataggtataaggacttgaatcctcttccctaaaaatctttcctccatctctctaatgataggggtgactttatctatttctaactctaactagtatttttttattcattatctctttatttcttgtaaaaaaattgtctttgacttttttaactgcaagactgcagtgtagtgtgaaaggtccgttttgatattagaagagatagaaaatgacaaaagataagataaggatagagaagatggacttgtggttgtaagttttaacgaagaaggcaaaaccaaagagccaggcacaaaactcaacgagaaaatagcgattagtgcgcagggcccaggcaggtaagagaagacaaactgtgttagacatgaaaatcagtgatgtgaaggtgaaaataagaaaaaggttgtcgaatttgatcttctttgttcttcagataaaattaatatttattgataaaaaaaattaacatttgcatggagcagcatggaaaggtgtgagaaagtgcatatatagagtaaggaatcaataaagtatttgttgaattagctggttgaggtgacagtggttgaggtaacagtgacagaatgaattggaaattatgataccaattccacatgcgtttcgaaaaaattaacattgcccacgtcgatcgagaactgttgacttttttgatgtgaagaaagatcagtaaggaacgccgactcgcacacattaattatgagagtttaaagttttcttctgttgctgatcaaaacttatcgaaataacacttgctgaactatggaactgagaagacaccaccaacaagtttggtttttggtgttaatggtgagaggtttgagctctcccacgttgacccctcaaccactttgctccaattcttacgcacaatttcgaaatacacctcaaaatacaccaccaaaaatagttgatcaaattccctttgtaaattttcctaggtcttcctctcttaatttcgaacgctttgacacaaatcacgcctcaattagacattcctatcaaaagttatgatcgtttgaaattcatgtacactacacctcaaaatgacgagtgtcacaaacacgtgaaatatgcctaaattttataaaataatatatatatatatatatatatattattttatacacattcttttttgtcaaataactcaaataaggtaatatttttttggtatatctatttatcaaaattatactgtgtaaatttttaaatgatttcaatttaaaaaaattaaaaaatcacaatattgtggttgcaacactaatttcaaaaattgaaaaaaaattatagtagaaattaaaaaattgattttaaagtcgtatgctaatttcagtcgcttacgcattttgagttggaattcgtggtagcaagcatttagcgactgaatttgtgatcgcaaatatttaacgatcgaattagcgacagaggtgttcatgcttaaattgggtgtgtttgacagccccagatttcaaattattttaaaagcaatcgtttttttcgaattatttattaaaaaagtattatgtatttaaatttgcccccattttctcctgtagtttttccttgagaggctttaacctttcaaccaagataccactgctaagcctaacagcttcacagcttgacttagctgatgttgtgcttccagcagttaattaacccccctttaatcaagctcacagtatcaggttgcacaacccttactttgtccaaaaaactatcagttctatcacattgcactgcaccaagtgcaaatgcagccatctgtttcaactttatccaaagaccttggcccaattcagttcctccaacttcaacaacaacagacccatctgaaaaaatactcaattttcctggagtagtttttacattcacctcatacaacactggcactcgagaaatccccttttcttccaagtgttaatcctgttaaactctttcaccaattcaaatctcacttcatagtttgcagaaacatttaacttactccatattaaaggcatagtatactcgtgaggctcaccacaagagtccttgtagaatgcctcgagacttgtgaaagaatctacatccattgaaagtgtggctgcaaccttttctattatagcttcagcaatgtatgatccttgctcatccccaggggctttcattgcagctctactaggatggtttgttttgcataattttatatcagaagagagagcaccccaaccccaatcatactttttaagtgcaccaatcatgttgcgtggtattattggactaacatcaacatatttccctgcattgatcaatatctcaagttagattcatggggtgccttcctccggccactgtctgatcaattcagatacaccctgaggggaaacgaccaataggctgatttttttccgttaattatcatttgggtcattttttaatctaaacaatcaaatagggtatttttccacttattaccaattgaggttgcatttcaaataaattgcggaaagggagtaactagcgttactatttcttattgagttgaaagtcgtaacattagttataatttttaatttatttttttataaaatttacaattttaaagttatattaattttttttaaaactgaaatcgtaatattttttactatttcaatcaagttttttttttaatttatgacgtcaaagttgtaaaattttgaagttgtatagtttttttttaaaagcagtaaaatttgttttattaaatttttttaaaataataatgttaacattaataaaataatgaattacgaaaaaatatatcaaaatgataaataaagccatataaaaaatttaaattaaataaaatattattaaaaattagaaaatattaaataaaactaaaaagtaaaaatatatttatttattaaataataaaattaaaatattatttataatttttttaaaaattgaaacaaacaaatttatcattttttcttaaaaataaaaaaacgttacaacttgaaagtagcaaatttccttaatagtgaagttgtatagtttttttagaaaaaattaataaaatttgttttttaatctatttttttagaaattgtgaataattttttaatttaattatttaataaataaatatatttttactttttatttttatttatattttgtatatattttatttaatattttttaaattttaatattatttaatttaaactaatttttgtatatgattttatttattattttattgtaaattaaaaaaaattaattgaagtcttaaaagtattacgacttcagtttaaaaaaattaatacaacttacaaatcataaattttttaaaaaaactaagtcagtaaaataatttataaattaaaccgattagatatagttaaaaacccgtacatcctgactgggcgccgcaatttgtgttctgccaatgcacatgttgtagcacgctgcgatatttgaatgtcataactatcatattaaatgtgctgctaatgcacatgactacagcaaaagactgttttcttctgtttaacagtgaattcttcaaactacagaaaatctaaatgttcatgcctagactctacatgttaattagtcatattcaagaaatgataacagatctaataataaagcagaaatattgtcaaaagcatagtacacaactaaaaacttactgccgtagctcttacgaccttttcaccaaaacctccaccaacccttctggtaatgacacgaacattattttcaggaatacctagccatcttgctacattagaatgaacatactcaggagattgacttgaaatgtaaaccacaatgcaattgtcatcaggtacagtaagtgcagtttgtgtctccatgtagaaatagtattgacacccaaatttcaactgcatttaacattgaatttgatacatgatgacaatgaccacgttttatctatataatctcatcaacactcattattcagaaacaaacttaaacatcacatcagaaaccaaagtagagaaacaatggatatgttacatgtacctcagcagaaagaatcttgtgatctgcttctgccattccttttaacacatcaccaacttgaattggggagagagaaggagataatttaaaaatgatagatcttttaacggcatctcgcatcttccacaattagaataggtggttcaagattttcaagactgtaatcaacaatagcagagtttgcagcaatatctgcaattttctgagtatctgcaacctatagaagatactaggtgactaaactggaagcatttcattttatcagtctccaaacaaatgaaacagaagctcaccacaaaggccagacgatcaccgtcacatctagctatctcttcagcaaataaaggttcttcaccaaagctagtctttgatacaatgttctgcccccaattgggtatgtcttcacttgaaatgatatccctcactccatccagttccaattcagggttgagttttatactctttactcttgctaaaggttttgaactattgatatatgttccatgtaggcaattttttggttatggaatgtcatcaagagggcgatttctgacacagtggtaaaattgtgccttggtgatttattggtcatgagttcaaattcggaaacagtctctttgcatatgcaagggtaagactgcgtacaatatcagtcccttttactttcgtatatcgaggaacatatggacaatggcgtacgatagtttttgttttttggaatgtcatcaacaaacagagcctcacctacatatgaaatattggtaaatatcaatgttacttggtgacatatattaataaatatatactttccacttatatgaaattaaaacaactaaatatgaaaaaccataattgaaaggcatcaaaacagataaaatatcagtgtctgacaaaaaaagcctagtcaactctaaagtaagaaagtgagagattgtgaattacatttatgtcaacattagctagctggtaaccggtgacatgatcagctttgagccaagccaagctacaggtgagtggacctctttttatctttggtcttcacaataatttactattttgaaatatcaatagagatgcaaagtaaaggagctgtcaatatcttaatccaaaacgccgagctaaacaaacctgaagcttgtagtgcagcaccagatttgatgactggctcaccaatgggttcatactcagtacctgctccccatatgacagtaaggctagaaatttgtcatgatgaacttgcttctgatttcacagatgacagattagtatgttcatttaaataaccatcggttattctttcagcactctcaatcaatgggttaaagaactgaaaaataaaaccagcagaaagacttgaacggtacgcggtttgtgaggtatcatcgtcaggtataatagtggctgtagccaagttgacagaatcatatagaatgctaacacttaacagctttccagttaagaattcctcaactttttttgctcttattgcatgcttagtcccataagcaccaaaagacaacctacaagtgtctatcacagatccaccagaatccttgcccaaggagacaccttagccaggaaagcagcatttaagtagggaagggcatttcctagcgatcgagaagaagctcggcaagtttcaaagaggaatctacttattggttctgaggattcacttttattgatttccaaactaggaattttaatgctcaaaagcacactttccaaacctaacggtggtctttctagaaattcctccagtgtcagccagtcaaattgtgtaccagtcattatgtgaaccattgactccacagcaagaagtattttgccaatatctgaggcaaaatgacgcttttgtgccatcactagattgccaccaacactggctgaggcaactttgttcatatggtcagcaatcttttcgagtatcattacataatctgagagaaagtcacttttgctctcttcctttagtgcttcaatggctttagatattgccactgctgttccaatttcaatcccttttcgatcctttctgacctttgagagctcgaaaatgcctcttagatcaacgtacatatcatagacttcattatctttgtaatatcccatacctgtatattactaacaacaagcttcatctgggttccatttacttggtttagcactaatattttctgaacactactacaatacaggctttctacatcggttctacgacgcattccacgtcgattatccaaccgtctttgtatccaatgtcgttgaaaggtaagactttctacgtccgttcttgaaccgtcttagagcatccgcgacgccgctgccatgaaggatccgatctagaagaaaaggggggtgagagtcagagaaagggtttggaggaagttttttttgaaagtgagaagcaacaaaacgaagggtcataataaacaaatgaatgcgtaaaccaagacagtttaccgtagtgggtgaaaagtaataatattcgaaaaatcacgagaatcgtagctattctaagatggttttcgtaaaatcgtcttagaatgatagtttctaagacggttttaataaaaccgttgtaaatagattgtaattatttacaaaaatgtcaccgtgtttctttctaagacggtttttcatcaaccgacgtggaatcagtgtcgtaaaaggcaattaatgtagtagtggaagctcctctagactagtaggactgtaccaacagtatttctcagaagccaaaggacacaataggcttgatttccataaataaataaataaataaacaaaggaaatctaatactattgtgaattttgtcatactgaggcaaccgactatgctttaagtccttgctctctccctttctccaaaaagagttgaaccccaaatcctctatatcaacatccgcagcaaagcttctgcaggcatcagcaatgggcctgtacccggtacagcgacaaaggttccctgcaatagccttttcagcctcagcagaagtcacttttgagaatccaggtggtgtctctggatgattggtcttttcagcattgacaatagtaccatagaggaaaacacacattccaggagtgcagaagccacattgagtggcatggaatccttcaattctttcatgaattgggtggaacccatatttactgtttccaatgccttcacttgttgttatggaacatccagtatgatacaaagtagtgtgagacaagagcttgctgtaaaatcctcaactctgtcatgcacaggatcatattcggagacaaactacgcatgcaccacaaccacctgaaacaaacaaacatgtcaaaacatgaacttcaaagttgaaaagttttggagaatatatcactaatggccaacatcttctccaccttcattttcatgacagaatcatcagaaacaacaagaggattttttttcttttttctcaattctccgtgtaagtttgcatgggttttagtcttgtgaaaaagagaagaaggagaaaaagaaaggcattggagaagttgttaaagcggaatctcataataaatagtatctccgaagatctgatctttaatcaagttggatagtattgtctagttcatgtatctgacttcacctagtgagataatgagattaggcttttgttgttgtcctcaaatcttggcataaacaattcttcttttgtatatgaaaaaaaaaaaattactcatatagctcaataataattaggaattagaaaccattacgttatcaactgaccatgatttgtgcgtgacgtgggtacatttggtacgttatttctggatttttccgccttactatttggtattttccatagagtaactcttactcaaaatcttaatttaagatgtttttatgataggaaaagacacaataacaacaacaaaaatgagtcatgcatgtcctagagtgatatattcctgagtttatcattttttaattcctaattttttaaagaattttatttttaatctttccatttttttattagattttttttctaaatttttagttcttttaataagagattaaaagtaaggacaacaaaaaagtcaaaggatcaaaatagataataaaaaactaaaaaaatttaaaaatataaaatttaaggactaaataaattatatacttatttagaaactacacttattttctatatgacagaccaaaaacattttcaggtattgataaggatgttattatttcaatgttgcctcgccactagctaatgtactaaagaacaaatatatataaagctgctgtcttgtccatgcaacctaatatataaggaataatgcaaaccctcaccaaggaacaatctgaagtctttatcttaatttacacacattaaagaatttgattaaatgtattctttagagagaaagaagctcatgatgtctatgatttaagttccaagcacgctgaagtccatgataaatgcctaagtgtttcgcatgaatattcgttgtgtcaccacaagatctgtagaaacgtaccttgaatccattgcccaagtgagtttccaataatactcacatatatgatttgttcaacaacttattagtataaatcttttctatatttatttctcagttacacaacaaccaccaaaaccctaaggacccggattactgaaagagctgtcatctgtatttaatttgaagaaaggtgaggtaggaacacaccacacaacctcttttgggattcctttgtttacatttagggagaaaacttcttgtgtagacttccatagcgacatgatttggttgagggagaacaaatctgtccaatcatcatcctggaaaatcttattttattaagtattattattattcttttttaaaaaaattcctttacttatgaatcgaaatcaatcttgcacttgacgacttacacttaaattattaataacgattcaattattatcattgttaacagattaaatataccaatttactaaatgattaacaatcatagttaaccaatcaacatgttaaccaataatgaacttatataaattgttcacacttcaaagtgtatgttgtcttctttataaagttttaaagatatagaaataacatactatatatatgtaaccatttcttttgaagaagtcgcgcggttacttaaaatatagtatttaaaaaaaaatcaaatctttctttaataaaagaagaaaaaatccttaacttttgtccaatcaatatttgtagtcaggaatcacgtggaggttttagcatcgccaaaacacaaagttacctcctctatgagaccaaagcatataatttttcgtgaatcagcaccctaataacagagacacaatgtttgcacgaaaagaaagtaataaagcaaaaagagaaattaacaggaactagaatttgcgtgcaaaatgcataatatataagctcccatcaatgtgcatataaatgcacactgccagagctttcattctccaacaacggagacaacaagagaagtcaaaagcaaaagatcaacaagtaaaagtaactatggcacaggcacaatcagcagctaattttgattaccaagattttgatccctttttcgaatggtctgaagacgaaggaagtgtcacgctcattgtaatgcttccaggtaattatcttctttaattttaccctatatatatatccgtgaaaattaacctatagtaatactccatttaattattatataagcaaacaactgccttctattgtatgtgtcaactcagtgatctaattcgtataattcataaatttaatttttttgagaaaaaatcattcatgaaccctagaataaatattatatatatatatatatatatattgtaaatagtttacatttgttattcaatatatattaagtttgttaatttttaaaacaaatgtatataaaatagattatgcactgataaaataaaataattttaaattatcatttaatcataatttatcatatataataaattttataaaatttataataattcttttaaaagtcatatatcaattatcatttataattgtataacattataaaattattataaattatcaatgtataattattaaattcaaatcatatatcttaaaattcatactaatgcatgctaatttaaactttaaatcatatagtattttatttttcggattaaaaataatcatactttctcacaactaaggtcacattcacattttgttttatgttatcaacacctcaaatttctctctttcaatcacatcataaactttattgtatttataattttttatttttaagtctctctctatatgtaaaatagtatgatggacactacataataaagcagattctactacatggttttaaagtcggttgccagaaaccgccttcaaatgtggtgcggtggcattttggtaataaatgggatgtttttaaagacggttattccaaaaccgcttttgaaacatttttcaaatacgattttttgttaaaatcgtcctaaaatttaaatactcaagctttaaaaattcatctttatttttctcgtgcctgctctcgcctgttcctctgctctcatgtcatattcatcaaacatttttcatacatatatactttgaacatgaacaggattcacaaaggaacaactaagggttcaagtaacttcaactcctgtgctaaggatcaatggtgaacgacagatcgttgagaacaagcggcgtcgtttttctagagaattccccattcccccatattgtgacaccaatgatgtgagtgctaagtttgagggtggcatcctaagcatcaagtttcaaaagctcatcacccctgctgctaggtcactgccacaggaagctccaacaatgcctcagaaagaaaaagaaccatcacaacaacaagatcaggttcataagctagagtcactacagaaagagaaagaaccaataactagtgatgagaaagaagagaacaaaacagaagagtcgtcaccacagaaagggaatgagccaattagtgatgatgacaaagaaaaggataacaaaacagaagaagtggttgctgaaaagaaggtgaggactaatggggtgccagagacagcaaaagaattaggaacaacaacaacaacctcatctaaaccaaagataacccagagactgaaaacaagggttttagatttcactgtgagtttgagatcagtagaagaccgggatgttgttaagcaggggtttggtggtaacaagtgtgcaaagctaattaagaggccaaagatatggatgaacatttttgtggtcatcttattggttatggtgctggggttgtatgtcaaaaatgctgcattcatgtcatctcataagggaggatcagaacttcaggaattcaaggaattttaattattcccatatatatatatgcgtaatattcatgcatgtcaacgcatgattgaattcaataaaggagtaaaacaactggtctgatcattgaacaattggattcaaaataatagaccagttttccccatgtaattctttctttctttttgagaaaatttgaaaagaaaaaaaaaacacaatggtttatttgaataaaaattgtttaaattcttcatcagagtaatcagtactgcaatttactggcataacattaacagatgcaaaggatttgagtcctacgactacttacatcagactaatcacccttattattattttcagttacttctatcacctttaatgttttactaccattattactactgataccttggagatactccattttacgtattagtttagtcgaatattttcaaatgacatttttataaattaaaaaaaaagtgccctaaataaaataaagtttgttcttcctttatatccacacactagttaaaatatttattaattttgtatgaataatctattatttgtttttatgattttatttttattatattttattaatatgaaatacactctatataaaaaaatattatttaatactaagatgtatcggaaacatatcaaaatattagtatttttgaagtaacgtatcaacgtcccgtatcgagaacatatcgaaaatgtggtgtcggtatcgatgcttcataggctgctaccaaagttttaaaacgtgaatctttaatatgatgaatatttaatctcttgaagaaaaatgtcttacattggaatgcttttttatcatttttatttaatctatttataattcatgattttaattccttaattttttcaagtaaattaaatcattctatttttaaaattaagtgaatttaatcctacatgcatgttatcacttttcttttgcctaaaatctcattttataattaaaaatcttcacaaacagaatcaattatgttgttttaaatttttttctctccaaagtccaccaactaaaacattaaactttgacaaagataatctatcttttctctcttttacatcgtgtaaaacatttctgaatttcattaatttctaacttttaaaattttaaagtcatgtgatattctaaatttatcgtacaatcttaaatattttaatataaatataataattaaagactaatacaattatagtataactctaagaaaagaaaagactaaaaactaataatgtagttaacccatttttttatcttgtgaaacactgatatagaaattagaaagtgagacatggagacacgaattacacgagcgaattgaaaacctccgaagcagctaatagtatatcgagagatggaaaaaagctgtaattttttatttgtcggttaaagatttgcactcggaacaaatttttgcttttgggttttagcatcaccaaagaacggggtcacctcctctcgttactaaagcatattatttttcttgcgccacacaaactaatagtgtttgaacgtacgaaaagaaactaagaaagcaaacaaaatgctactacattttgcgtgcaaaatggtcctaattgcctcatcaatgatgagtataaaaagaagccctagaagcaattcaataccaagaagcaaatatacatcaaacgcaaaagcaaaagagaaacaaatcaaggataaaatcaaatgggttcaaggacacagccagcagcatctgatcgtgtctacgaagactttgtaccattgtatgaatgggatagaaatgaaagggttgtcaatgttatgctaccaggtaaatgttttttcaagttttcaaatctaacctagaggaataatatcaacttaattattagttcattgttataagttataacataagcaacagataaagaaattagttttgttttcatatatttttgtctttataggtaacgttcatcgtcaatctggtttttatatagaaaatactcaatttattctatatgtgtataaatatttccgaatttgctcaccttaattatttgttagtcgaacaatagaataaaattgatagagttattttttttcctacaaatgttagtttattattttttttctttcaaaatatcaattgaaaaatttgaatccacaatttctctctttcttttcttttcgttattatttaaccattaaatcaatcttatataactaattaatagagttgtttcagttaaaaatattgagaattatcacatctgaggatgaaaaaaaatagaggttgcattaatttactctaaataatgaattataatcagttactatccaaaatcatgatatcatcatgcatgatatatacatcttttttgcaatgaattaatctcaaactttttttaaaacatcatatcaacctaaaacttatgagaatatcttattatttcactgaaaagtcgtaaatctaataactgtggttaccaaaagaaataaagcctcttttgctattttcgtctaactttatgtatttgcaaaatcaaaaaagaaatacgcttcatctgctttcaatattattatcaccatatacaggttttagaagggatcaattgaaggttcaagtgacctcaaagcccaccctaaggctaatgggtgaacgactgatcactaacaacagatggcgtcgtttcaatctagaattgcctcttctttctgattatgacaccgacagtgtgactgccaagtttgagggtgctaagctatcaatcaaatttggagaactttcactgactaagcccaaggaaacattaacaacttccccatcacaaaaatttgaacagcaaaagccaacccaagaaggtaaagcagaagaagcaaagaccaatggtgaagtctatgatcgaaagacaccacagaataaggaggaaaccaacaaaactgaaacaaaaggtgctctggaagcaaagactgatgaaggctcaagtaaaacaaaagaagcaccaactcctactgctcctaagactaagcctgtttcaagaagcaaaacaaggctaatagatttcagcctcggttctggatcaaatcatgttgatggtgaagtcattgaagatttggaggcagggaagaacaagtgcaagaaattggtgaaatggatggtgataatctacttggttgtggcccttgtgggacttggggtttactatggcaaaaatgcattgacatcataccctgaagaatcatacttccaagagctgtgagattttcgccctcaagtactgctacttgtacaagtaaagagaagaacactttattcatttgcgtgtaaatgcatgaattcaataaaagaataaagtaaaaaatgtttgaggtttcacaactataatttgagctcattgagtcattgtatccgttgtatttctaatacattcatctacaattaaatgactcaaattctgcagtataatttcccgtagtgttgcttataaaatctatctaaagattcaggagcaaaggaagatgcaaatgaatggagatttatagagtatcctaaagctattgatgaaatgaaaaaaatatcaatcgtattaaaaaaaattgacacttatttttttcttaacacttcataattattgtccttaaaatagctactgtgtctaacacaaatgtggacatgatagtgatctttcaaaaatagtcttttaaatagtcaatttatcacatacaacaatgaaaaactctatcaagtctaatcctaatcctctgttaattaaataagaaaagcaatattcccaatataaaaatatagctacaaaattcaaaattattaaatgctcaatagatgggtccaacaatactagtacattcttagaaggataatgctcaccgactgaaaaccctctatatctctcaagaaaaacatatacaaagagaatgaaattgatgactacttcaaaactgcataaactccaattctgactaccttacattctttctaagtatattcttcagttagagacttaaaacaattatctcttcttcattcatactacattcacaagaaaataattatattttttttctctctttaaaatgcttgtgaagcctaaagaaatttttattttaaaaaatgatcgagttcaagtcaaaaaacttgcgaaaaaaaaaatacttcgaaagtggagattagaaatattctatctctcaattatagtaatagaaattgtctgtcaaggactcgatttatatttgaattgtggggtgaaacaatataaaattattgttttaatctttttctcccttacatctgtttatccgtttttctaatcaaaggagagattaatttgttcaaatttattttttttgaaaaaagagattttcttaaaaattattttcactgtgtcattggtcttaagacaatattctttcatcccagactaacctttctttgcatagatttgtttttcttcaaggtcttttttttaataaaatcatgtgatcaatcaaattgcttttataaagattacaaaacaaaattcaattctccttctggtgttttttatttgtcttttacatcatcttacagtttaattaggattttcacccttcacagttttacttttatgataaaatataaagataaacttttcgagcattgaatgataactgcactattccgtacgtattcctcgaatttgaacacgggggcaaaatgttgaaggcaaagccgagaagaaaatatactaattaacttcacttgcaacaggaacaagagacatcagagtcaacaccagtggctagcatataactctgttcccacacatctgcaggaactgcttcggcatgaggaacgtgacgaggatgtttttctctcttgtctcccctgagctgcttcagaccacgcttaagtgctggcaataaagcttccatacactcagcaacagcatttgggtttccatgcatgttaatgatctgaatttcaacaaatcaaggaccataaagcaatttagtaacaaaagtaatttcaatcttaaagattaaagctactgtaaaattggcgttctcaattcccgataacagtgccaaaaacttgttgcgaaacggcaaatgcacctttcgtttcaaataataaagtgagtaagtagagtatcgtctccacagggattgagatacaaattttatcgcaacttattatcttaagattggaagataatatttatgaaaagaatatgattgaattttagaattacgaaaattaaataactgaatagaaaattaacgagaattcaaaaagaagttttaattaaatgttacgcagtattgagaaataattgtggtcagagcacctctacttctgatccctatcttctatatacaaattggtgattgatttcaattgttataattgctcagaggatgtatttgatataatttagttaaatcataatcccttagtaatttaaccctttaacccaattagaaatcttaattccttagtaattctttattaagttaagcattaggaaaatacatcaattattctataattgtccatccctatccctaagtaatgtaacaattatcaattattattctaccgctatcagaaatcagagttccaacatccctattgtaaaccctaacccttagaaccctaatagagtgatcaattctattgaagcgaaggcaatataagcgcaagatagaataaaacaatcataacattaatctcaataccaatttaatacagaggagttcacatcagttttttgctctaaccacaataaggaaaattagccagacatgctcataactaaccttcattgcaaaactaacatgtatctaagagagaattataagaaatagaagaattataagctgctccgtcttccttcaatcttctctttgcgtttatccttgtgtttctgtgtttttccactgtccaaaagtgtcttttatttatttttccacgtccatatagttaattaggtcactaaaccctttctggcgttctatttccatgccaaatcacttaaatctggaagttgcgtgtttttggcgctactagcgtgaacctggcgctattggcgtggctcttcagaggaaaataaggcttctctgattaatggcgctaacagcgtgggatatcatgctaatagcgtgagatcacagtggagaacaggtccttcaagcagctggtgccaatagcgtgaagctggcgcgactaacgtgggcaggcagagagcacttgttacctcctgttgcttcttttcctctctttttgattcctaaacaacaaagtatgaataaaataggtaataaaccaagaattgatgacacttacctcattctatcctatattaataatttatgattgaattattgatcaatttaacctaaaaactattgtatgctagcagcatatcagctgcttcagaccatgcttaagtgctggcaataaagcttccatacactcagcaacagcatttgggtttccatgcatgttaatgatctgaatttcaacaaatcaaggaccataacttagccgataaatacaagtctagaagaaagacagattacatatccggatctaggttgtactagttacaacaataaatgcaagattttccttaactactcatgatacagccccaatgcagcaccattttagagccaagggcacttgtataccataagtaaatggatgaaacttaagtaactagtaataaaaacaaattatcaaataaaagaagctttggaatctatatgatttgagttttctgaaaatagtaactgtttaactaaaagaatcatgctgtaaccatgaagattgaatacaataggtaccttcaaactcaaataactaaaatctagcaacagtacaagacatggacgttttatccctcctaatattctttttgataaaccagcagagttttaatcatacgaaatgtgttggtaatataatcaattttcttgttttcttattatttctaaaagaacacttgttatttcttgtcatcaccctcggttaattaatttatgactaaaaagactttctaactgttttaacaaaccattttttctgccatccaataacagataattactttctcattggttgttactgataggatattgtacaagtgggagaataagatattttcctagaacagcccataaaaagaaaaagagaaccacgcaaaaccatcaaagaacattttaacaataaaatcaaccattgttaaaaaaaatggggcatagccacttccttgcatggtgatttgggtaaattttggtaaagagtttcaaacttctcaacttattcattaggcagtgcacaaacagctaattgagaaagacagagaatgaagaataaataagacaacaaaaaatgtataatcctattacagcataaaatactataaaactataaaccccatgtgttatacaaaggatgcgtgaaaaatcaataatatgaagcctcagccagatacaatgtacataagtttctgcagtcaacagaacactcaacactactacactacaacagagcaatgcccaaaacagagtttttatcttccaaacacttcaacaatgagactgttgcaaaacactcagtacatccaatgccccttttggcatcgactaatatcaagttcgctttttagtttagcatcaaacttgtgacctctttcaaacaatgattcaaagaggtgtatctagatgccattcagcattatccaactaggaagatgatttaccaataatgcaacattggctaatttgactatttcaacacatacgaatcctgttgcagatgagcatagctaaatctagctttagtggtaacaaatgccacattgctcggttcctttagtatccacagaaaaattttctttggtttggaagagtatactagatgcactcgattaacaacaaaaattcctatttaactttggaggccaagcaagaaaaaacatgatgaatatgaccaatacctcattaaccttgtctagagtattgttagtaccagtttcaggaagtaaaaaaaaaaaggtgcagtgtggagtttctgcttctgcaagatttcattagtagaagctgctttatctagaaagtacaaaaactacttaagtcttaaacattccacacaaattgatcaaataccagaaaaatcaattaaagtgctcccgtcattcaaaacagaaatccaaataggctaaaaaaatgctttaatcctgattttcaactctatgtatgtctccttgtttgcattcaccagtatataatataaaatgaagaccaataccttcgatctgggccagcacccgtagcaactgtatcactaactgtaagaatagccactctgacttcagcatcccctgaagaatcagtagttactttatgtgatttaattccaggcaaagcaaaggctgagtctgatgacttatgattctcatcacatgccatgggtcttaggtcacaaattatgatagattacacagcggtccctgcagaaactacactgcctgttgctggaaactccaacaaggcattagctgacttcatactaagtagtcggctgctcacttgatgaccagtgctcacagcaaaaaaactgcaattcgtggacaggataaaaaattcattcattaaagagaccagatcaaattagcaacagtgctcggccctccgcataatacccacctcttcctccccacaaaaaaaaaatgaaaagacatgcaaaagaacaaaacaagaacaaaacaattcgtcgtcaacttaccctggattgcatgttccatcattgtcagcccatataacagaagcacgatgatattctggctaactggatctgtctttgtgagttgacaaagccgagcttgtgccctgcatacaaaagaaactaaatgaatcaaaaccatcaaaagcaaactatcttaaaaacaattgtactttggaaatttacgtaacctcaaatgctggtattaaagaagaaaaataaaaagagagatgtagaattgtctaagattttttacatattcagtatgtttatcatttttaaagaaattaaatttaaaaaaaataaacatttttgacagagacaaattatcacaaattgttatattacgaagaataagaaagattaaaaaagtgacatttaaaaaatttgaggaaccagtaaattaaattaaaaaaacattttgacagtgagaaattattaaaaattgtgatatcattaacaccaagaataagaaggactaaaagtgacttttaaaaaatttgagaaaccagtaaaaataaattcttttttaaaaaactaaaaaaaataattatctaaagttaaaggacaaaaacatatttaagttaaataaataacatttcctctcggatgaacctatccataaaccttaaaaaaaaaaataagaaaatgaaatcaacttgtctcgtaaactaaaattgatttatgtaattgatttatacagaaaaatcctcgtctaatttctctaaaaactataatgcgtaagttgattttaaacatcacggagaagtttatcctcaatgaaagtggaatggggaaaatgagaagtggaaaagcgaaactctggttgttacgtgagcgacagttccaggggagaaagtgatgccgagagcgtcatctcctgctcttgattgggcaacgacgggttactcgccggggccatcggcggcgaggacggcgtaactgtccttgacggaggccgggtacggcgggagagggtcgggagcgcgaacgtcttgcgccaagaccttggcaagatattggtgaaggggaacagtgagtgggggaagcgtttagaggggccgtgtcaagtgtgagttgtgacagtctagtcattgaacttgtaaatccaatatttatatttatgataaataatatttttttacgtgaatgtataaaatattaataaaacttgtcaatgaaaatttaaatttttattcttgaaaatgaaaaaaagtttgacgaatttattcttccattaactttgataagttattatcaatatttatgaacaaatttgtcaatgtattatacgggataaatttatcaattctctattaaaatataatttaatattcatattttctcttttttaatcattacaaatataatattacaataaatatttaaaaataaagaaaataaatataacttaaaacaaccataataataagcataatattaattaataaatataaactctcaaatttttattataataacaataaataataacaaaatcaaattatatctcatttttattgtaagaattaacttaaacaaacaaaaatgtagagacaaaactaacaaaaaatactaaattacaaggatgaaaaatgtatttaaatctaattttaatatcatatagataagctatttataagttactaatgttgatcttgtaaagtttgaacttgactcatttaaattatcgggctcaaacttaagcttgaatttgtttatttgattttaaataaacaaacttgatcgaatatttataattaatcaaacttaaataattcacaaatagtttgacttatttacattccatgataaaactactatttattttctagttttagataattactaattagtctttcttatccaactctttctaaataaattattttgtagataagattgatttatatattctatacaagggtaagagtgacttatataagactaaataattattttgttattgaatgtgtaaaaactaaaaaaatgtgacattatgttatatagtcaacttaatataaaattagtcattacatattataatttaataataaatggtccaacaaatttaatgataggatgaaattgtcaaatttttcacatttaaagattaaatcaaatattttctatattttttccctcaatgttaatcttcttgtcaactaccaacttgaatgaataacattcgcaatcggtaatttgctacattaccagcaagtctgattgtggtagagactcgtgatttttttataaactatgttttaatctaaatatgtttgtgattttataaagttgaagggtgaaattcaaaaaaattcatcaatctatggattttaaaactaccgagaatttaatacattcatttcctcacaggacagtttttattctttgaaacacattgtggaacacaattatttttagataacataaaataagaagaaaggaagacacaattttttaaatatatatttttattattgattaaaatttattaaaaattataaaattatatgagtatatatgatattcaatgaatatctcttatgatattgtaattttctataaatataaatggataaaacaattatatttgtgagaatatatctaacttgtaagtaaaataacatgaatttcattcttttaatgtaatttttaatttatcaaaagaaaaattaatttcttacataataaattgatgttttctttcctctgtttcaaaataatttgcattctaaatggatcaacacaactcaagatttttttataaaagattaataattttataaaattaaccatccataacacttctccagctccacgttagtataccgcacaaacattctagaaaatttccaattcagggggcagcaatgatattccccaccccctgacgtcaacgttacctgaaaaccgtgacgcaccccgtggcgtcgtctttattccgttctccgcccaacacaccacctctcctttctcctctcccccaaaatttcaaataaaaatttcaaattccaaatacctcagattcgcaaaaatcccttctccgtcgccacatcgcatgaaccttgaattccgatttggataggcatgtctggagcggcgttatcgccgccgacgagttcgaagtcggtgatgcagacggtgaacggttcgcacaagttcgtgatcgaggggtattcgctggcgaaagggatgggagtggggaagcacattgcgagcgacgtgttcacggtgggaggttaccactgggcgatctacttctaccccgacggcaagaatcccgaggacaattccgcctacgtctccgtcttcatcgccttggccagcgaaggcaccgacgtcagggcgctcttcgagctcactctccttgaccagagcggccaggggaagcacaagcttcatagccatttcgatcgcttcctcgagaccggtccctacacgctcaagtacaagggaagcatgtggtacgctttcaccatgctctgctgccaataacctttctttatctgttttggtgccttcgtgtttttttttttttttttatcttgattgtgcctctatgttttgaatgtttgtagtttaaagttttaatgatcattagaccgtggtttttcaataatataaagagaaaggacaaaatttagatgcagttcgataggtgcttttggtgtttttctcctattacaattgaagtttcactctgggaatcctgcattggcatttagtggaaacctttattagacgaattaccgaagtgaaacttcaatttcttattagaggacaacaccaaaagtagcacatatggaactgtatctaagttttccttctcgcgtactatgaaattgtcattgttatgtacatcaatttactaaaactccatgtgattttttctttggaagtcgtaatttatcttcttttttactttgagcaaatcatactaacactccctgaggtttcttgacattgtgcatgactacttgatttattcatgtttatagcaaccctttataggggtagatggtgtaatgtatgtgtgtttgtgacaagaggtgttagtgtaatgtttttcataccattaagtggatcggtgtaagggtaaaaaaaggagacatattgggggaaatttgtcgaaatctcaaagagtgttaggataatttgttccttatctttttattgatcatgcttgatcatgtccttgtaattagcttaccaaaaaggttatacaggtcagttagctttccagttcttatgttttttaatggtttatataaagatttgtattgtcatattatgcatgaaggtttcacaagcaaaaaagatcttctctcttttaaagggttattgatgtgttcctgtttttgatttctgtccctggttatctctcccaggctctccttatatggaaaattgatgctagatcagtctgaaagtatgctgttcagatgttgtgtcaacatgtgtaaaatctttatctcttttttgtgcttttataggggctacaagcggtttttcagacggtctttgcttgaaacctctgatttcctcaagaatgattgtttaaaaatcaactgtacagttggagttgtggtttcagcaattgattgcccacaactttactctattaacatcccggaatctgacattggatcacactttggtgcactattggataatatggaaggttcagatattacttttgatgtagctggggaaaagttccctgctcataagttgatgttggctgccagatccccagaatttcgatctaaattttttaatggtttagatgaggaaaagaatgagattattgtaacagatttagaaccaaaggtttttaaggtaaaaactatttgtttcccctttccttattttccttccctggtagcatcaagcttgttcaggatttattttgttattgtatatttttctgttagctttctttttcttgatagaaaaaggatcttataggagttcaagagttaaagtacaactagagaggatggatatcctgattattcctcttttacaggccatgctgtactttatctacaaagatactcttacagaagaggtgggcacggtttcatcaaccacaactagcaattttccggtttctgagacattgatagcaaaattgttagctgcagccgacaagtatggcttgggtaggcttagattgatgtgtgaatcttgtctttgtaaggacatttgtgtgaattctgtagccaatattttaaccttggctgatcattgccatgcctcggagttgaaagctgtttgcctaaaatttgctgctcaaaatctagcaggtatacttaatttgtattactttcttagttagcaatggcaatcgtgctaacagaaagactgatgttttctgtttaacttttgttgttaacaagtgactaaaaaatgtaaaagaaaaatgagttcagatacatgcatcctgtgctaactaaacacagctgtctggcatacacaactagataccaagcagaaaagatagattttatagataggcctattttgggtaagatcctgtataaacacttgtaggagaagaaaataagaaagaaaaataaaataagtttctcctcagctaaaattagtttatgcataaatactagtggagaacaaaataaaatttcttgacttcaggcatactaaattacaatcttgctttatcttccaacttttctcattcttgatatgatggctctttttgcgtctggacttgttgcagctgtcatgagatcagatggatttgagcatatgaaagaaaaaggcccatggctacaatcagagatcctgaagacaattgctgggtgtgaaggtgagggttgcagtgcagtggaaaaatctcagagtgtatggggccacctttcagatggtggtgacaagaatggtagaagggtcaggcagagaatctgatatatgttgtcacaccggtatctctctgattcttttgtaaaatgtaggtgataatgctgaaaatttggggggtaaaaaagaaaacagcaaagaagagggaaaaccctcttctgttcaacttttccatgtttaaatggaaagtttagaaaaagcaggtagactaaatgttatgcaggtttttttttttttaatgtaaatgtcatcagtgggtgtatgttgttagtgcagaatggtaattgaaaatgagcttatctgcagtagactattgatactgactatactttggaagtggatatttggttgctggactttatctcttccatttgctttctccttttctgtagtcggttccaaccgaatgtttgtagaagtaggttcattaggatggctgttgttatacaacttcaacattaacattacaacacctttaatccatgctaattggggtcggtggtagatgactcaatgatagatacgagaaggttgaaaaaaaaaagtggaaggtgaaggagaagggaaagggaaataattaaaaaataaaaaataaaaaaaaaagaatagggaaagaaggagaggggagatgaagaggaaaaagactaaaaaaagatcatctagaacatagagataataatgggtgtaacccttcaccaagcttaaaaaaagatccgtcaatctatatctcactccattaaatcttgtttaactacattttcccaagtaaatttcggtctacctctatctttgtttgtgcagagcttttggtaacaaacttttgttcttacgggaacatccagggaacgtctcattacgtgccaaaaccacctcaatctatgtttccttatcctttcactcaccggtattactgttacctttcttcgaatatcttcatttcttattttattcatcttggtataatcacacatcaaccttaacatcctcatttctgctatccctattttatgctcattctatctatgtgctggccaacatttagctccatataacatggaatgtcttacatttgttctatagaaattttcttttagcttaagaaaaattttacggtcacacaaaaatccagatgcactctgccatttcatccaccctgctctgattctatgatttacatctccatcaatctctccacctttttgcaaaattgattctaggtatctagaaacatctttctttggtacctctggaccaaataaatgcacgggatcttgatcaccatctcttaccagggaaaatccacacttcatatactcagtcttgttccaacttaacgtgaatcctttagactccaaagtgtttctccacagttcaagtttcctattaacaccatctttggtcttatcagtaagcacaatatcatctgcaaaaaacatatacaacagtacttccttttgaatattttttgttagttcatttatcattaaggcaaatagataagaactaagagtcgaaccttggtgtacatctaccgtgataagaaaataacttgatgtttcattaaaagctttcacacatgtggtagtcccatcatacatatctttaattgcatttagatactttaatgatatttttttcttcttgagagtccaccataaaacttttcttgtgatcctatcttatactttctcaagatctatgaacacatatgtaagtctttcttcttttctcgatattgttacattaatcgtcgtataaaaaaatagttttcatgtgacataaatccaaattgatttacaaaaattttgggctctctcctcaagcaatatttaataactctctctcacaactagtatgactcataagcttaatgtctctagagtcagaacaattatgaatatctcccttatttttgtaaataggcataaacatatttttcctccaaacatcagacatcttatttgtttgaagaatcttattaaaaagattggtcagttattttattgtcacatccccaaggtctctccacactttaatagggacgtcatcgagtcctaaagctttattatttttcatcatctttaaagtttcattaacttcatgtgtattaattctgcgcacaaatcttttatttagatcatcataagcgttctccaagtcgacctcacttttgtctccacctccattaaaaagtttgttaaagtagttcattcatatttcatttacatcttcgtttcttaccaaaattttttattttcattcttgatgcatctaacttgagtgaggtcttttctcttttaatccctcatttttgtaattttttatatacttttttttaccatccttgctcccaaggtttttatacaaattggttgtccctagcatcctgcattgcattctttgcttttttttctcgctaatctaaacctttgcaagttttcatcattgagacttttatgcaaagatgtaaaacattcattcttctgtttaattgtcttctgccctctccattccaccaccatgttttctttgtaagaaatatgttttctttgctttctctcaacaccttcctttccacattttggatacacataatcatctcattccatatttcatttgtttctcctacagacttccacgatccttcacgcaacatgctttctttgaactttatttgtttttgtttttcctcatttagcttccatcatcttataattgggttttgagtcatcttcctcttttaagtactttgttgaatcgaacctctagaactaccaattcatgtggtgtagcgacacactctccaggatagaccttgcagtcaatacaagaatttttatcttctcttctaactataaagacatcaatttgactacgattttggtcattatggaaagttataagatgagactccattttttcagaaaaaagtgttcgctagtatcaaatcgtagactagtgcaacgttcaagatatattctctagtctcatttttcgtaccatagccaaaacctccatgaattttatcaaaatctgcattatttttaccagcatgatcatttaattctctttttagggaaatcttctctcatggtatttctctcaaaatctcttctaagtcttctcaaaattggttcttatcaattacatatttaaaattaaatccctcactacaaatttgatcataatcttcttgttaccttttcttttgttataccatgtacaaaatattcattttgtaacaattgtgttttcatggcacaccttcaaaggagcttcgactcagttacaccagtcatgccaaagaaacgtaaaataatacgggtcccctaaatcctaatatactaataattagcaccacctctcttttttggtaatgtttcgttaagaaaatctgaaatttgaggagttgagggaatacaatgttggttcggtgatgatacccacaatttgttacaccatatattacagttgtgacgaaaatcagaaacacattcattatcgaatcaaacattaagattttgtagtttcttgaaaatattaacccaaaatataattcttacattttaattctgttaacttatatttaatattcttcgacaatcaaatttattatataagaagtgaaattctcataagaataccacgagtctaaaaaaatcaattaccaattaaaaaatgtattcgaaagatgttaatgtgttactaacattctaaagaaaatatcattagtacgaagaactcaattaacaaataacaggaattttaatgcaaagaaattttatgaaaactcaacttttatttcaaccatcatgtatgtttaataattttttagttgataaaatttcattccttacttttcatattattcgtaccaaagaactttcttgtaaattgtatatccttttattttttggttgaatcattgtatgtatttttttcaacaagaattcaaatattaatttgtcatgttatagattactagactcaattcctattggtaaatatcttgaaatacaaaacatatatatatatatatatatatatatataactcttaattacacaagtatagctaacggaatttaagtttagtagaatggattaatttttcacattatgataaattaaggttcaaactccactaaaagaaatacttacctttaggctttgtttggaagttaggaggaaagaaaatgaaagagattgaaggagaagggagggaaagaaaagtgaggaaaaatgagagaagttcattcctttttgtttgggagttaaaaatatattaagagaggaaaatataaaattaataagatattaaatgtgaaaattataatttaaatgtaaaaatatattaaaaatatattttaatatatttttgaatgtgtagttgggataggataataattttaattatttttccttttaaaaatttccacattggggaaactacaatttataggctttggaggatttcagaggagttttaaaaattctcaaatccttttacttaaaaattaaaattcccaaacaatgagatgtctctatctaaacatttatcttcccttccttgccctctaaatttcctctcccaaacaaaacattagtgtccaacggtatctcgaaaagaaccttctaggaggttacatacatatatagtggggaaattatacaagtacaatattttagcctaaaagttttgataaaaatgaagttacccacattttaaaatactaagatgaagtattaaaatgaatgggctcaaatactaagcccaaagccaatcccacgttttatttcatttcaaccgttgtcgtttggttgaaacaataggtcaatagcattagcatagcatcccacaaaacctgaaaacctagcagaagcaagtgcaccggaaacaaagcagaaagcagcgatggaaaaccactcagatgaggagaatggcgtagcagaagaacctcaagcacttgaacagaaggagaagcgaaaggggaagcacgacaagccgaagccatgggacgacgacccaaacatcgaccactggaagatcgagaagttcgacccttcgtggaacgacggcggcatgctcgaagtcagctccttctccactctcttccctcagtaccgcgaaaagtacctccaagaagcttggcccatggtcaaatcctctctcaaggaattcggtgttgcttgcgaactcaacctcgtaactaccttactctgttactcattctcttttttcctcctctagtttcaatccaaaaccctaatttcgccttcgattgtgacaatgcacaggttgagggttccatgactgtttcaaccaccaggaagactagggacccctatattatcatcaaagccagggatcttatcaagcttctatcacgaagtattcctgctcctcaggtatgtgtgtgtgtgtgtgtgtgtgtgtgtgtgtgtgtgtgtgtgtgtgtgtgtttgtaacttctttctgttttttttataaaaaaaattcagtcatattaatgttatttatgttgctatgattgttctcaggcgataaaaatacttgacgatgagacgcaatgtgacatcattaaaatcagcggcatggttcgtaataaggtattttctccgaagattttgcaaatgttttactgcgtgttcttcttgattgctgtgtgcctctatggttttgttttgttttatctttgaatatctattagcgatgatgcctctgccagttctatagtgctgctactgcgtgtgattgactaccctcatgataatggtcacttggtcaggaatggtatgcactactgacaagatttgtggagcaataatcattcgtcttagtatacatgggaactgagatttagacgcaactatgacagttatgtgtagaaaataactgatagtagttatgtattaggagtatatatctgacagtaggtagtgtcaagttattttcagtttgttgaaagagaataatgagacttctgtctctgggaacagcaagagtgtggctgtatttgtgtaacagtcgacttttgtttctagggcagcaagtgtattgccatgttgtgtgtgatttcagtgttcaatataataatttattactttattaattggtgttctattaccttcttaggcaccagagtaatacaaatagaactcataagctatttttggttaagctttattgaattgcacccccaaagtcctctctttagctgctaaagaaattcacgttaaaataatttgaactgaacacgcacacttcaagctttccattgcaatgaaattaactaagcactgtcaggagaccttccttagtaacattccagaaatttgaaaccatcgggctgccatggaagttattttttccccttgtccttacttgaactgctcttttgattttgtattctaccatatgatttttgtattttgtcataatactttatgcaacttaagcatttcagagaaattagtctgatggtaggaagttcccttgattttctgactgcaggagcgatttgtaaaaagaaggcaacatcttgtgggccccaattcttccaccttgaaggtgtgctttgtctgaagattttattttttcagcatttgggggataaaccctttgttgttactttcttgctttgattttctggtactgcttatcaccaattgttggcttcaactttgtgactcgcctttctccaactataatactggcttgcaggctcttgaaatactcactggctgctacaatctcgtccaagtaattttgacttacgcttcatagtttagaatgtgaagactgtacatttactttcattatgatatgagtgtagtctagaatcagctgatttctttttaattttgcacgcaatttgacagggaaacacggttgctgctatgggttcattcaaaggcttgaagcaagtcagaagaattgttgaagaatgcatgctgaataaaatgcatcctgtatacaacattaaggttatttaatttgtattttatccagctttcctttgtggtatagattttgggtgtagaaaatatctcaattcttcttttcacattgtcaggttcttatgatgaagaaagaacttgaaaaggatccagcacttgcccaggagaactgggataggttccttccaaaattcaagaagtatgccttttatttatttgataaattgtatactcaaggtactcacccaccctctgcttcagtttcattgacgcttcatatctttttgtaggaaaaatgttaagcaaaagaaggttaacactaaacagaagaaaccatacactcctttccctccacctcaacagcccagtaaggtaagacaacctctaattaatatctctgatcaagctggatttcttccactaatgtacagagtctcctctactcatgtccccaacaacaacaaagtaaataattgactagcaaaaatatgtatgtattatatatatatatatatatatatatatatatatataagcagtaccagtagtactattatctgtacatccgagtgtgccaattatcaaagtaagattatggtatggaaatattctatgaatattagaataccataatgcccaaccctaggcacacaggaatacccattacaaaagtgtctatggcctaatccctcccctatacaaaaatccagatttaatattactagcccaaaagtggaatggaagctcaaaatcattatctaaatatctaagccatgtccagcagaagaaaattgcatcctccatcaatttctgtccattaaactccacatttgaaaaaacaattctgtttctgagattccaaatgcaccatgtgagagcaacctaccaaatccgccagctgttatggctagtcttttgattcttttgattgcactgtcacccagacttcttcctgtagctccttcctcagcctgatatctttctcattcaaatccctttcttccccttccttgttctgtattgtagtaggacccgactgagcccacctgcattttctggctatgttgtaattagtgtttaagcatttgctttcctatcatagtttctggtaattgctattgattttttaaagtaaaaaccttgtactttgtctctaactgatattttgaggggtatcaccttccactttaatttgtggcaatagacataggtgattgattgtgaaagatgattaagattcaactttgaggtttatcttcaggagttgatatggtccccttgtgggtatcttaggtatttttttttttgggtttctatcataacgactgtatcagacttagctcaagtgtgcattatctaggagcaatttgtgaatatatgaacttcatcttggcctttaaatgagaatgacaacaccaattccacaactacttgctgccctccgcttatattggcttttttcttttatttcccccctggggtagtttatctgtattatatctaagtttttgacaaactatgttgttctggtactttgttaatctatgaaataaattttaaggtgtctttggtaatttatgtgacatttcagattgatatacaattagaaactggagaatactttttaagtaacaaaaggaaatcagcaaagatatggcaagagaagcaggagaagcaggctgagaaaactgctgaaaacaaaaggaaaagagaagaggcctttatcccacccaaggtttatattgttatttcttttgcgattttctctactattcacaacaatttatgtcgtgcgtactattttatagtttttttttttaaacttttatttgcaccctttaggagcctacaaatctggtggataaatctgaggatgctaacaataatgtagctgacatggcaatgtccttaaaggtaaataagtttctggcggaactttattaagaattttttctctttcttgtttggccagttagaattgttggtttctttgcctaactggtattttctcttaaataaatcatcatctcacttaaattcaaaatggttcgtccgcagaaaaaaacagagaagtttgggaagcgtaaatctgaagaaaatataagtgccgagacatatattgtaggatcatcagaacaagcatcgggaaagaaacccaagaagcaaaggtcttaaacataatcttcattttggagatgaaagatgagcatgtgatttggatgtgaatttaatcaagatcttctgtatccaatgtcttggcagtaacagttttgacaccattgtatgaggcatagttgttcattccatttgtcgtggagatgagtgcgtggcatttttgtatcttattgtacttgccaatagacattcagtaacatgtacaacacttctagtcctttaagttttacatcttttccttttcaaaaacattgtccgacacacatgttgatactatatctatagttttgacaatgtgatttatttgttaaatttggtctagtctcaaaaataaaagggaaaaagaatcagaaacacatttattcgagtttgccacttaagttgtttttaacgaaaccaaaatgaagtcacaaaatcagcaacgtatatggatattcttctaattttcctttcgtaagtttaataaatttatagatccctactaccatagttttaaagatcgaaatagttaaggcgacatacttaaagcattggatcaatggttgtcaataaataactaatttacttgcatgatcctgtctgtataaaaataatataaaaaaattatacatttattaaaatgtttcaaaaaaaaatcactactcataaacataataaagtgtcaagtacctaaagttattaagcatagacattttttaaacacaacaaattgaggtagtactgaaacaaatcaataatcacattacaagaaagttgtgtcattttgagtcattttaaagcaaaaaaaagttgcatgatttggtcctcatcaaaaggttaattacttatttatcaacaaacctaattggattgcaccaagttgaatgcatgacttgtctgataaccaacttgacctaatcaaatcattttctgaccattcaatttggcttggattttaaaacaggtttactattgagattatcattttaattcataaaatttattgtaaaataattaagagtattttggttaaaatataattaatgcaaaagataatttgaaaaaaatcttataaaaggaactaacaaaattaaaaaataaaacttatattttggaaagaagaaagcatatgaaaatagaaagatgtttactgaacctttactactgtgaggatctttattgatttaaaaaataaaaataaaaatgtaataaatactaaacttcaatgaaatgaattagacatgtatataagtatacccgtatatgccagtttatagttggcttggtggttttataaataaaaaaaagttgatttagtggtgaagaaaaaaatataatattgtgagtttgaattttctcattaacaaataataataaattaataattaatatttgtcaataaaagaatatgttactttaaacattattatgtggatatatagataaaacttaaaaatgactttgaaatgatgaagtggaaaaaataaattttgcagtttggattttggatttaatgaaaatacatttttttggtgcggaatggaaatacatttccaacattaatttatgtaaacatggtaaatattaatttatacaagcgtgcttaaactttaaatattagcatatgaaaagaaaaatcagggttgataaaagtcatcacggatggagactctcctgtcctgacacttctctcgtacgtataaatatttatttttaagttacttaatataaaattaattatttgttattatataataattataataaccattaagattagttagtataaaattagttgttttcattattattattattattataattaaggaaataattataataaaattttgtaaaattaattgtgtgttggttatttttatgataatggttaagattattatcatttaaataaaaaatagttttaattttatgtgaaaaaataataaatattttttaaaatatcattacttattaaaaattagacatttaaataattataaagattttttaactcttttaataagtttttgtttccgtctctggtcttcatgtgatatataaagtaatatttagaacctaacaatacttggcaattaatagtacgagttttcctaaccaaacaaatttaactatattgaaaaaattgaattaaaaaattaaattattataaaaatatataaaaaatggaagggtgaaatattattcatcaagaaggaattatattagataggataggatatcctccgcaatgacacaaagtatgttacaagaaaattatacaagttctcaaaaaataattttttttaattatttatgcatatcattcatgtaatcttaaatcataataataataataataaataaataaataaataaaagtatccagtacaccaaaaaaaaagtatccaaaatttattcattacaattttaaaaacataaatacaaaaaaataaagtattgaatattgcaaaaaaggaaccataattaattgacaaaaaaaattaaaagataatatattgagcggataaaaaaaatgtaataatataaaatatcaaaggttcctctatatattttccacaattttcttcgaagttaataaaagacaactattaatttcttcataatgtgaaattcaaaggttcctcttttcctccttgttaaaactgtgttagtattctgtttgagatgttagaatacttgtctttattttaggcatcccatatggaatgatattaggtgatttttgtgccatttcattaagcatatcatatgttcacttttttgttcaaatattcatctgatggaagttgttgtctagctaaaaggaatgatgatgaagatgatgaagatgatgaaggatgttcagagactagtaattgtcacccaggtattgctgtttataatttaattaaaatcaagttcatatgtttattctttcctctaaagtggtatcattcaaattaggtttcaattttacattcatattacccaaacagcaatggtgatgaaaattaaaataatttgagggtcttctgatttgatggatgttcagaggtgggaactacataactatattgctctgtatactacttaattataagttataactatagggctatgtaatgtcttttttttttgtttgaacgaaaactgatttaaccataatatgttagaatgttaattacaattaattgattatttaataattttatattttaatgcaaggttatcaaatttagtcaaatcgtgaatcattatttgcataaaatcggattcagagacaattaaaaataacttaatctaatagtttaaacttaaaatagataaaagcaacttaatcaaacatcttataaaacaaaattagtttgtgaagtcactattttagaagaatgaaaacaaagcaatgaaatagccaaatagagtgcatgcattgaatgaatgacaaataaaataagtgcaataatcaaataggataagtttgtaagtgctcatcatattcctttccatttaacaatttaagcttatatgacttctcaatttctttcacgtgaataggtaaaagaaaggtaaagagaaaaagaatgaaatgagattcatcttatgatacaatctatagatagatgtatcgtattgaacgtaggattcaaatcatgaattgtaagattctaataactacgttctaatgtacagaatggtgatcctaaacaaagatctagaggtggtagtaaagaatcaatatccatttccaatgagcttgcttccgcaataaatgatggtctttacttctacgagcaggttgagtcactattcttatttcccctgttgtcttttatttttcagatcatcatctttattaaatttttggttgccccacccattatctacaggaactgaaacataggcggtctaatcgtagaaagaataactctgatagcagagatcgaaacataaaatctccaagccataattcgggtgcatcaaatataaaggcagttgagaatattggtggaaacagtgttgaagagtctggaagctataattctcgaaggaaacaaaaagtttttcacaagcaaccatcttcccttaagcagcggtttttctcaagtaattttagaaatcatggaactggtcgaaactctcatggaatcatatctgaaagcccgcctagtaattcggttgggtttttctttgcttctacgcctcctgaaaatcacgggtcagttcaaaatgattgttcccagtgctaatgactgtaatattggtttgcatagccagcctttttattttcacttttatcctttactggaagaatatatagtaaataatttgttaaattaagaatataaattattactgtttcagagagtatgatatgacatgttgattgtttggtttgacaactgaagctatttccattaattatcttaaatttgcagtttcaagccttccaaattgagtagttcaccacatgagggtctttctagtagtccccatggggggttttctggtagtccacatgggggttttgctggtagtccaccgtttcagcatccaagtcaccaacttttagaagaaaacggtttcaaacaacagaagtaaatgataatgcatactggttgtatgcatgagagtggtactaggatatagtcctataggatttgctttttaaaaattcctcatgttagtattcttcctttcaggtacttgaagtatcacaaacggtgcttgaatgatagaaagaaacttggaattggttgcagcgaggtgaactccatttcttacgtttctatgaaaaaatatttgtaaagaaccacattggtagcccaccgattgaactcagtctcaatttctgttcctgttacttttattgtgcatcatgcaccgaatgtttaatatattgcctgccttttttattacttaatttgttaattgaatgacttatcttctaaagtactttgtgtacgagtatgttgcaatagttcgagtgaaaattgtggaatagttacgatggcattttcaatattggtttgcattggtcaactttctctttttaacttaacaatgtcattagccgaagctttcatatcaaaatgagcctggatgcagtgctgccatcttcattagctcactttgtgtattatgcattcatattttttttatacatttcggttttcatattatttgcaaatttaatatttttgtattatattctttttaaatcatacacttgcttattctggtaggtttttctttctcctccttttgtgtgtcaatgcaggaaatgaatacattatacagattctggtcctattttcttcgagacatgttcgtgccttctatgtataatgaatttaagaaattagctaaggaagatgctgcggctaattataattatggtatagaatgccttttcagattttacaggtaccaattccaattctatcttttctcatttgtttgagaagatagaaccatcatttagatttcatcttctggtccattttgttgagtaaagtaataggctaatttcaagtcttctgaattttcatctattgtttctttggagaagctgattaaattgctttatgttgtcaatttttatttttccttagaagacatccaagcatagttcttctaatttttgaatgatttcttgctcagttatggattggagaaggaatttagagatgatttatacgatgattttgaacaactcactatggatttctaccataagggcaatctgtatggcctggaaaaatattggtaaaaaaccaaattctcttgcttcttatattctactgcatattttctgttttgtagtttcattccttttcccaatttcatgtgagatttgttatagtgaaagaagtaaacatattggttggttagtctataacctaagttgtattctagattaaaaagattgttcactggtctatgaaatctaattatacagtaccttagttatatttgattatttcctgtttgtctgacttgtttgtgtcacaaaatctttataacatagtttctgactgcattattggactgaaatggagcattttgtttattcttgatggtagatttgtggaacagtatgagcagttctaaatgttaagaatgtgcatgttataacactactcacctatgcttagctaatccaaaatagatcatcatattggaaatatgttagtttctatgtcaaatgctagcatactattttattaatattgcatttctatatttttgggtgaatggaggttgccatattctaaggcaaggcactgtctccctcatatctgttggatatagagaaatgtagttttcttctgttgttttggcactcctcttcaccatattatcactctctagaacttttgttcttacatatttatatttatatttatggcattggcagggcatttcatcattaccgcaaggtccgtggccagaaagaaccgttgaatcaacaccctgaactggacaggttgcttcgagaagagtatcctagattggaggatttccgtgccaaagaaaagagtatggtaaaagaggatgtcaattaagttgagtgatatgtccaaatggtaaatacatatggcagagttttgatggcatccccaattttgatgagaactcttaacaacataacaatgagttgttgtggagtagcggccaactttttgaaagaagattgtttgtttcttctctatatttggttgagttgattatgcctcatcaagaggattgctgatagccaagtcttttcaggtttctttgatggatcattctatatggtatataccactgcatcctttctttggtgaatcttgcaaacattgagagacacattttcttttctccaaatgttgtacataagttgatagactagaagttgtgacattacagcataagaaaaagaggttcttgtttttatttttggtgggggttaaaagggggaaaagggttgtacttatatctttgccaaatttgaacaataagagtgagaatcttcttactttgtaacttggcgtgctcatttaatttatatgtaacaattattgtcttaccaaattgttattggtatggtttataaagcaaaatgtttttggtacaactaaaatgggactagttgtctcctttaattttgggagagtatttttggaatgattgtctgtcaaaaagataaaagtcaaggtaaaataattatatgcagtgtaagatgaaatgaatttaaattatttgatgtttctttatcatcatcaacatcacatttagcctaagttaannnnnnnnnnnnnnnngaaaaagttaaaaaaaaaaaaacaaatgctaagaaaaagaagaaatgagacaagagaaaagaaaaaattatttgatgtttcttgataaaaaaaatattagttaatgtttatagcaagtaaaattagtcactgaaatggagatattcatgacagaaccaaaaaattatttaatgttcaagtaatgggaatcgagtttaaaagttgaaaacatagttttggtggttgtcaagcctgtttagcagcatcgcagccaatgaaaacatgtcagtcagtttccaaattttatgaacggtgagaacaaagataaataaatgattctaagaaatccatataagcactttccattggaaatgctcttattaccctatatcaagtattattgtttcttaatttattgtgtgctctttttaaaacaaaatcattattttgaaaaataaaaatattattttctaaattctgattgcacaaaatacaagaacatcattgaaatgagaaaatcatatatttaaataacttttttatatatttttaaatttttatatttcagaattttcttaacattttaatttgaggtcaaatttgaattcttaattataacaatatattattagatacattttaagataatttgatgttattgaattctgtttcaataaattactttttatgttctaaaaatattgatacacaataatataggctattttgagtattttttttcttttgtaattaatacttaagtttctttgatttggtaattatcttataaactactttgctacacaagtttattttagtgacttattttcataaactactttgctacacaataaatcaggacggatatcagttatcccataccccccggttttaattaacagggaaaatctgaccctaatcccgaacccgatcgacttgattttttcccgtcaaagtcggggagagtttgattcgatccccacggggtcggattccgctgtcatgcctaataccaaatcatgtttttccctctctattttttagtaatattggtgactttttaatatttcatttatcttttaaataaattctaaaatatattttgtttaaaaattaaaaaaatcaatcaaattacttaattaaatcaatctaattttttggattgataaattttgaaatatctaaaaaatcttattgtattcaatcatttgaaatattttaattggtttaaatctattttttttattggtcaactttgagattttcaaataaaaataggtgaatattgaataatgcagtgcatttatttaaataacaggtaagggtaggaaggaaatcaactttggtcgactcgatttagaaagatttgtgactaatctgttaattgaaatataagagttaattttagtttaattatattatataaattattttaaaatttagtttaagtcttatacttcttaaaaaattatttaaaatctcactttttagtgataatattaacaaataaaattatgaaattacttataaataagttaattaatataattatgtaaatttaaactttaataaattaataaacatatgatttgaaaagatgatgataaaatttatataataatatattatgtatattatttagagaaatgttaataatatactccctaacatactatttataacacatatgtaatattagttaaaatttattaaaaactatagaattgagaaaaagtttttaaataagaagtaggatcattaaaatttgtgacttttaataaattttaactaataataaatattgtgtttaatattactttttaaaaatgtattactataatttctcatttatttggataagtaaatttattatgattaacaattttgaaatctttggaaaaacaactttgaaagaaaaaaaaaataaatttcaaattttaaagaataatgagtgtcacttgggcgccaaattttagcgcgtcatgctttgttaaataagaagccctgtgaacggaaagaaaggcaatttgagtttgaagcttcaaactttgaaagccataaaagaagaaaacaatgtctgagttatataataacgattggaatgatgatgtttatgactacaatctgctttttgattgcgatgatatatggtcgacgctgaactttgctacccagattcctatggcggaggacacccaacaccaccacacaccgctgaacgttgcaaccctagttgcggaggacacccaacaccaccagacaccgctgaacgttgctacccaggttgcggaggacacccaacaccaccgcacaccgctgaacgttgctacccaggttgcggaggacacccaacaccaccagacaccgctgaacgttgcaaccctagttgcggaggacacccaacaccaccagacaccgctgaacgttgctacccaggttgcggaggacacccaacaccaccgcacaccgctgaacgttgctaccctggttgcggaggacacccaacaccaccagacaccgctgaacgttgcaaccctagttgcggaggacacccaacaccaccagacattgcccaatcacgtgaaccagattgcgtgggctccggtcgagttgcccagccacccagttgaggcgctggtgcataacggtggtggttccatgatgcagacacctggttcatcgattcggcgcaagcaagggagaaggaatccatggactgaagaagaacataggtaggcttttaatatattgtatagaaatcaaatgaatggaagtttctcaatttttcgtctcatatttgttttttaatggcaggttgtttttacttggactccaaaaacatgggaagggaaactggatagaaatatcaaggttggttaaaacaagatcccctactcaaattgccagtcatgcccaaaagtatttcattcgccaaaatgcctcacccatacagaaaaaaagaaaaagcattcatgatataaaattacattacacaaatggagttccttacatcattgatccacaaaattcaattcctcttactggaattcaacaagttcaggaaatgcaacaaaaacaacaaatgttgccactgaatccaccaaatagcatgactcatcaaatgagtggatttgattctgcatatcaacaagttcatgaaaatcaacaaatattacacgtgaatccatcaaacagcccgactcttcaacttagtggatttgaatatggtgatgaccacattggaatacaaggcttgctggaagctgtactatctgtaatattttcaccgtagtatgattctttaatcctagcataggttgtggtctggtgtaaggtgtaagagtagtgaacttatcaagtaattagggattttgatatttgtacatggattagatattggaattttctcatcaattactttcttttattgactttgatgtgcaggtcgtgaccaacttttagtaataatattacaatcaatttcattcttaaaaggaaaagtaaacttgtattttttataataaattttaaagacttcttcctcatctgatccaagatgaatagcacacatgcacttgacatattaccatgcatactcgctgagcaaatgtctagtagcttccattttttcaggcttacactagtgccttttcgatattcttagagatgagtccaggaacatccttgaggggatggaaagtgagtccaacttggcgaaggtggccatcaatagccccttcactgtatggaaggatggtgcaccatatccaaacaatagccttgttggtacatcatgtaaagctaggcatgtcgacaccgctggtggtgcaaaagatgagatgggtagtcttggacttgggttgaccccattccttgatcgatcgccttagttgcagcctcttttcccaactttggtacctccacaaccaccatggcttgccttgcatccaatgaagttgggaggagtggcggtgccgatagccatgacagtggcagggccttctgcacgttgtgcctgacggatctcttcaacactgttaattttctgaagcaaagaatgaaagtgaagaagtagcaacgaaagaaaaggctttgatggatgttgcaaagtgggtttggaagggtggatatatatatatatatatagagagagagagagagagagagagacgtagaatgatagaatgatgcataattgaattgaaaagggtaggtacatgcatgcagtgcatgcttccttcctctgatattgcgcttgtggtgtgcacccactgcatgtctaagttcaccgctgacaaccaacccacttgtttcctctttggaattacttttctattgctgttttttaaagagagttttcagaaaaataattattttcaatcacgtgttgttttttcgttttcctctttagttcattatcttccacaattattttactttgatatatcaagttttaaaaattttattttactcttttatgtttttaaaatatattgttttgatcattctttcaatttttcatttaaaacgttaatatttcgttaatttttaaatttaaaataatcaaaatgatacatttagaaaacataaagaatcaaaatgatacattttaattaatggatttcctaactaatctacccaagattatctaaccaaattgagtaatttaatataaaatattacttttaaattttatcaattaacaaatgatcactagtacacaattaattagaataggccattaaccaaatctaaccaatttggttatgtagtttgttgtgaggtctaacatgtttttaaataatatattttataaaattaaaaatattattttttatattatgattacattaaatagaataacattattgaaataagtaaataatatatttgaaggaaattaattttaaaatattttagtttttctttaaatttatcttatatttcaatttttctaagcttttttagtttgcggcaatttcttgaattcgtaattacaacaatatatttagtaaatatcttttaattatttactaaatttattaatgtagaagcgagaaaaaggagtcagtcattaaaaagggcacgtataattgtagattaatttattactgtagattattatactttatcttttgactatgacttagatgttgttatgcttgcaagactttagatatgataggaacgagtacagtgtactagaggtgagcaaggcttagttatgagaattgcatggacacaggatttgttcataacatatcaaggggtgcaagaagagacgtgtttcatctaactgaattcaagacctactacttcttaagtggtggaggctattgttggcatgggatgaaggttgctatatctgttactgaaggtgttgctgcacccactccagcaccttcaccaaaaggtggtgctccagcaagttcaccagaatgtggtgctccagcaccttcaccagaaagttgttgtgcttcagatggcattcaagtcaaccaaatacctttggtgttaatctttgtcttgatgtgggatatctcttctgataacaccagttactagaaatggtaggccatatgtactatagcaccagttgtaattgttgtattgattttactgtgtgatggtaagttaaactatggaattcaaggtatcttttaaatttactaataaattgtttggcctagtggtgtggtttagatagtttatatgaagttgtaagttcaaatttcattgtcccgctatcgtacacaaaaataaataaagaatctattcgcacatactactattataatagtaatgccaaacaatattatttgagaaaaagataaaagaaaaaaagggaagagagattgtttatcatgaactaattttaatgttttttttcgtttttaacaaatcaacaattttggatcatgtgctattacttaaaacttaccaacaaagcaaattttccattagttttgtgtaaatagctactgcaaatgttggatttaaatgaaccctatatagggaagaacaacaggattaataagggaccatattctttggtttcatgcgaggcagttgccaatacaaaatatagagaatccgtatgggcacgaaacaaagtaaaatataacttgttactacattaaacatttcctccaaaaccaatagtattagatggcacaaaagacaaaaaaattatcaataagatctctttgtgccgtttgatttgaagctcggtgcaatgaagtgaacttttgcgtgatatgatcaaaaagcacacaaaaaatcaagcataactgttcagcaccaacatcagaataacaaagagaacaaaaacttttttggtgtctgctgtttgtccgtgttcagggtaggggatcagaatttagaaccataatgacttccattagaaagaaaacaacaaacatattacttttatgaccaacattgcctttgaaaaggtatttgcgattaacagtcaagaacagtgaatatcttttacggcttctcgtgttgaatctgttctacagtcaaggttggtaacaaagccacagcctcaccatcaatcacaagaaggtcatcattcttgaaacaccttgtcttaaactttgcactgaatagcattgagaaacattcatttagaaacaaaattactccttgtttaaaaaagaatgcacaataataacagcaggactaaacttacagatatcgatttttattttctctcagattagttgcttgcacttcaccaataatctgatctccaatatagactgggaacttaaaattcaagttttgagatacatacacagctccaggctgcaattattgaaaattgaagtggccagggaagaagaggaatttaagaaagttatcacagaatgagaatatttcaatgaatgacttcatagcattgcctcaattcacatcattaagcactttaaaatcaagtcttttattcaagttgaccaaatccaatgacaagttccaatttttcaagcagtagaactagaacccatgttagcatttaaattgaccacttaatagcatgttggtgatttgcattttccaaccatccaaaaccaaattcacgtcaagtatgccaagttaatgtggaagctaaaaaaatttacttcaaaaggacgcggatcacactgacataacgccaatccagacacacgataagtcctttatccatgtttatattttcatgtctttcagaaatactataaaatttaagctttttacatgtgtctccctttctacttctgattaatcatgacacattttaatctatgcaataagtgaggggtcacttgaccttatttcacactccttatagtggacattacaatttcacatcttatccgtcttcattttatgatactctatctcatgtcataattttccattatggtgtctaatactcaagtttacagaaaggatgttcatgggggcaaggggatttggacccggaatcaacttagagttccccaaagctgctgacggtggcagaaatttcacacttacaaaaagcacaaacaaattaacttttacatgtaaaaatgtatgctacagagtacagagtataaaattcagtctagaaaactaataatagaactctactaatttatctgtttattcacattaatttaatattgagatgagaacgttaactatctcattttaggaggcatatcaaaatttaaagagagggtaagtatgaaacttacaaaatgtgatgagatgatatgaggaaagagagaagccacaagcatcccatgtaccagtggaccttcaaatccaacatctttggcagcagcagaatcagtatgcaaaggattagaatcacaactcaccttggagtattggagaacatcttcctcagtataaacccttgcttttctcaagacatccccaggcttaattacattaggagttgcagaagtaaagcaccttaggctcagagaatggactttgtgacaatgtaaatttcttatgagcatttttgcaagggttcaaatcaacaaaacaaggccctgatgtggtcccccactaactgtaaatcaagtaaagtacaacttaatattcccacaactggtagatgtggtttcttgaggtaactggtggcatggacttaggtcaaacagctggtgggcgtttgagcagcacgggaaacagtgtacattggtcaatggtatgggttcattgctcttggagggatattaacacaagcagaattatagggtgctgttgtcaagggattattggtctcatgcactatgtttgtcaaaatctgataagttttatggagctagtttttttacggatcaggattcaacgaaacggaaagatgcaccacacaggtaaataagaaaaaataaggaattacttttaaatttttacaaaataaattaattttttttaattttttttttcatttttagaggttgagtatatgtatatccaacttattttatgtcaatgtaactcttcactcatcaatttttttcttgcatgatcctgtattcctgtatcaatggttgtcaataaataactaatttacttgcatgatcctgtattcctgcctgtattaaaataatataaaaaatttatacatttattaaaaagtttcaaaagaaatcactattataatgattaaggtgacaattataataaaattttgaaaaattaattgtgtttgttatttttatgacaatggttaaaattattatcatttaaataaaaaatagttttaattttatgtgaaaaaataataattttttaaatattattacttattaaaaattagacatttaaataattataaagaatttttttaactcttttaataagtttttgaatccgtctcttgtcatcatgtgatatataaagtaatatttagaacctaacatacttggcaattaatagtaccagttttcctaaccaaacaaatttaactatattgaaaaaattgaatcaaaaaattaaattattataaaaatatataaaaaaatggaagggtgaaatattattaacaaaatacatcaagaaggaattagatttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtaatcttaaataataataataataataataaataaataaataaataaaagtatccagtacaccaaaaaaaagtatccaaatttattcacatacaattttaaaaacataaatacaaaaaaataaagtattgaatattgcaaaaaaggaaccataatttattgacaaaaaaattaatagataatatgttgagcggataaaaaaaatgtaatatattgagagattaaatctttataaaatatatcatgattaaaattacgggaaagataagcataatcaaataaataaaacataaatctaacattaagaaaaaattgaaaaggatgatctacaaaaattgggttcctctgcaaaatatataaaggtgtggtatagatacctcgtcaaagtgcaatacttggttcccaagaaataagacagcgtctatagcaattttaaattgatcacaaaagttttcatagagatggagtggtgcgatcattgttgcaggttttgtcaaacaagagtggaaaacatcatcgatgaatcttcaggcaaatattgcaggtgaagtatatatattactagtgttgttcctattttctttcctcttaaggtttttgggggaaactattattatattttcacgccattaatgatttttaatgtcttgtattttgcagctcttgcaccatgtgtgggaagattttattagacttgggtagtaatcctagaagaataaagaaaaggagaaagagcannnnnnnnnnggtttttttttttttttttgttaattaatattttgaaaataacttgctatgtatatcttaattatgcttttctctgttcatatgtttttgaagatttagactttaaagtgcacctttaaaattatcttttctgggattgagttttctggtgtattgtagtatttggtttcaatcagttgaaaagtatgtctaattttcatgataaatgaagctgtggaaggttcaaattgtaataagagaaccatgatccttgatcttaatttgtttatgtccctattcatctcctaaattgtgatctccatcacaaaggatcctacattctattagataaatacttgaatgcataaccactagggtcaatctagtgacagagatttaagttaatatgcataagatcataagtttgaacctatcattgtaaaaaaaaaaaaaaaaagataaatacttatttgtaaacgcccatgccatgattccaccatacagggaaatttttgtcttgtcatactttcttatctgggttgcctgtgtctgaatgcttccttttttgtgatattgggctcttaaattctaacttctttttttttttttttgtatttaagcaatcttattcttttgttcagttagatcatttaattgcaatatgttgtgtggatgcatccttattgcaccctgccctggggcatggccaacaggatgtccacccagagtctaaaattttttgtctaggtagtttaagtaaaatttattttttttaaaaaaataaaataaaaataaaatctatgttaggggttcattttatgtattagagacccattttttccatctcttagttttaatattatttgtatttcaaaaaaattgtgtgtcagggtccattttttccatcccttagttttaatattatttgtatttcaaaaaatttatatattaggggtccattttttatatgttagaggtccatttttttcatcccttagttttaatattatttgtatttcaaaaaatttgtgtattaagggctcatttttttcatctcttagttttaatattatttatatttcaaaaaatttgtgtattaggggcccatttttttcacttcaccctagatcaaagaattttcaggaacgacccagaagcttctaagggtcctctgatcaaggaagcaaagcaaccaattaattctgacacagcttaagtttctgattctgaaaattgttgaagaaacgttgttcagtgttgcttaatgtgctgtagattaaaggtttaattatcaattttgtttttaaattattttaaataatttaatctaatttctattttttttttagaatttgaggaccaagttaaacgatttaaaataatttaaggaatgaattgattcattttttaaaatttgaaatcaaattgaatcttttaaaaaattagggattaaattgttttatttaaaagaatttgaagatgaagttaaatctttaaaaaaaattggaaaccaaattatattgttttattttttttaggatatatgtccaaatgttctcacccttgaaggtagctctgcttagtgccatattaaaccaatccctttggttgacattattttgatataggtgacttttattaagaaagttgttaggatgggtccaaaaaggttcataaatgctctcaaacctatgtggaaaaaagactatattggatgaacttttatatttattgtagtttttatttaatttatttttaaaataacagacacatgaataattagtatcttaggactatatataaatgtattatttctttagaaaaccaatcaatgaaaatatcccgtctttattttactgcgttatttccctttttattctagatcaggttatttttctgtagaggtagttttagcatcttaacgaaagctgatagaacaaagttgcaattgataaccaccatttttgtttttcttaacaaatatggtttgtggttgaaaattttaccgtatgatttgttctttttgcttgttgtggataaacctgttatcatcgatgcaatactctgtatttgaaaaaagggtaaacgttaatttgttaaagaaatatatcaattatgtatattaacaaatgcatcaactggagatgagaggtttagactagacacaatttatcttaattttttaattaatttaatctctctattttttaaattatgcaaattctatcgctttgttgaatttcttatatttgaaattttcattttcattttatgtccaaatacttgggatttatgggatatgaagtcgtttttaaaagtttagaagcaggaggtttagtgaagttttaatataaaaaattaagataaattaagagcacttttaccttaaaaaacgttttttgttttcaccttttacttacaaaatgatcatcttattttcagtctttttttttttttgctttcaaatatttttacaagaaaaaaaaaaacttttctctattcctgaacaatttttttaaaacaggaaatagattaaaaattaggttacaatgatataattaaaagtcaaaacaggaaataaaaaacaggaaatgaaaatagaaaaggttggtaaaatttgacactttggttggtaaaatttgtaagaagaaaggtttaaacaatttatgtatacgaaacttgaaagagagatcaaatttgcttgatttaaaaaaaattagagatataattaactcaaaaaaaacctagaagatgaaaatgacttacatttcaaattaaagaaataaaaagttaatgtaaaatgacatttttaataaataatttatgaagagattacgtcttaataataataataaaaaaaaaacatatgcaatgatatatattttataaaggtgtagtgtatatgcttaatcaatgctatttactggcttcccaaggattcaggacactctgttttgcttatttatgtgactttgaaactgaacgcaattgttaccattgaaatggagatggagtggtgtagtcattgttgcaggctttgccccaccagattggaaaccatctatggtgacatttccgtcaactcttgcaggttaacaactattactactattctcttttcttctctatttttatgctacaaatataaacaatccaatttggcttgtcataaacaatcgaaatatttaaaatcacatttgaaacgtgaaaaatcatatcagaattgtagaacccgaagagtctgcgtgtaagatctcgctgcttttggggaaacagtctattttgtatgagaatctatgttcaattctgattgtgtaaattttcttaggtcaataacagttacgttctgccagcggaattagtctataatttagtgaattgagagacatttgtggtcactaaccaggaaaaagaaaaagaatggtaaagaaccaaatatgttagtattaataagactaatgtaaacaatcgaaattggcttgttaaaatattaaaaaaaaaaaagttgagataatgggggaaaataatggggattctttgtttgtaaaattgtggactttcatgccattgattgatcctagtgatattcaaatttcaatgtgttttgtttacagcgtctgcgctctatgtggaaaggttctgttagacttgaatgcatcgctccacgtaatgttttcaaataagaaaataaataaaagttctagaagaaagaagagagggagaaatatcaagaatgatgtacaagctcagcaagaagaaagtgtaagtacattgatttgtcctcaattttgttcccttttttttgtctgtggaattttgcacgtatagcagctgaattggtcataagttgctatgtaaattctgcatttgttctgtatttagtctctaacgttttgtgacttttagagtgcattgttgaactgtcttttatctgagttttttactttaatgttgctgcttctgtttgggcactgctcagaggaatgttatgattttgaatctagattcaaatatggtattatttgattacaatcagctaaagtgtctaatgttcatgatgaggaaaatggtgaaaaatttatggtcggaattgcaatagagaacctctatatcacattcattaaaaataaagatcaattgaagccttgatcttcgtttatgttggtttcatagacagactccatcatctatgtctcaaatgaaatgagaataaaacttaataaacgtagttcaattgacaacacacactgagaagtaaaaagcatgagttagattctcgcatgatacactcttgaagagaagtaaaaaactttaagtatgactaaatttcaaatccagtgattacggttcttgttaataaaaaaatgaaatgagaataatccttcttctcctctttgaaacaaggagcatttctgattttattgatactgtatatttggagttaattttacataagaatcaactcaacttaatcatttattgtcgttactctttggttctctgttaaaattcataatgtataactactcaaattgaatcaatgatcgatttttatgtttcattatgaacctaattgattagttccaacaatgtgtaccaatactttagtgctaaaaagtaaaaacaatggcatgtctacatggggaaatttggtctgttgcatttacagtgttttttgtatgtgtacatgtgatcatattttcttgcctctactggatgcctccttttgttatttttgttcaattcagctattaattaaagagttatttatcatttattttttgtattcagttaaatggtttaattgaaaatatgtttcatgtgtggacactttttacaggatacaagtcagacttcagataattttgaagcagtgtaattctgtgttgctttgtattctttagatttaccatcttaactggttgatgtttttgtgttcctaataaagctgataattaggacagagctccaactgatagattatgttaggtaatttcttttaccctttgctacaagtctacattcatttaataattagtattttacccaagtttcaagataatcaccatacttgttatctaggattgtggatgaagaatgttttatgatttatttcttcatgcttattaaaggatatgcaaacataaattaagattaaataaataagtgaattgagagcatatactaaatacaaacgtctaaatcaactaaaccaatcaataagtgttgtgcaatagacagctaaacttataagggagaatttaagattaattatcacataacatgtctttgaagagaaataaagaactttaagattgattgaagattagttttattgtcatcttaaaggattaaaacttgcaaaaatatctcaaagtgtcattagaggataaggatcaaataccctaattatgatggttaaaaatctaagttaatcttgagatcttgagagtgaacgataagttgctgacaaaacagaataaacttgggtgaactatatttgataaatctaactgtagtcttgtgtttggatgggagttcaaggggtgtcaatataattgggattcctttaatcttcatcctatagatttcatttgtttttttttcttaaaaaaataaaaataaaccggactatagaaaattttggtcttctagtgtttcttatgtttaaacataattatattataggcttaaaatgaatttcgaggtgtgatgcctttgtaaaactaattttgacaaaaaaatataataatgttattaaaatggttatgttttcatttaaaatttatatatatttaaagatttttgagatgtaaaattatttattaaaatagtgtaatcaattttgtttaaacatattttaatcaataataaagtctatttgtataatctttgttgagacattgttgatcctaaattataagattgtattaattttagttttgaaaaaacttattgaagaagtggctacaagaaacattaacattattatataagtaatatatgcatttgaaaaagaatcaagtttttttatataatttcttttacaacttttagttttgcaagtaaacctaatccatcaataaatcaatggttatcatgttttaacaaatgtccaaggttaagagaattttctttaaaatttccactatccaattaatttattttctcaacactatatggaaaaccaaaaaaaaaacttcatacattttaaatcattcaaaattactttgtaatacaacaattatttgatctattttttgctaatcatgttatcggtataaagttgttcctcgccgaaagtcataataaatctccgtcaaaaaacatgaacacatagaaggtgagtatttattttctaacatgatttatttgatatccaagggtcaacaaaatttgaaaattagaccacttgattaaatgacacaagtcattattacttgtgttaataattatttattaattttaagtgattctttaagaagtaaccaattttaagtgattctttaagaaattttataaattcattatcaatcatcttatcaaaatttttttttatgaataatatgttttttttttctccacaaaatttaaagtgttataatgttcttgctataatttacaatctatagtattaacaagaggaatacagatgaagtggaatgatgcgcatttaagaaaaaatttaaaacttatctagtaattctttccttattggataagtcagtcattaaaattttacaaacaacccataaaccttccatatgtacttgaacaatttattctaacattgaaaatgcttgaaatcaaattattaattttgatttgttgcatttcataaaaaggcatatcatcaatttgtcattttgaaaatgttagaagaaagtaacgggttgaaccaaccctattaatttcataaaagtagtttaacaatatttgttccaagacaatttaaggagatgctcaaactctttaaacgaagaaaggccttaccttcaaattttgaaagtagtttttattactttttatatattatctcgttttttcagaaatattttagatgagaatttctataaagatgtgattagatattacatatgagtgtgtgtttttaataaaagtttgaatttataattaaaaaaacagaagatctaattgaacttattttaaaaaataataaaggatctagttgaatttttaaataataagagcatcaaattgaatttaaaaataaattagaggataaaagaattaaaacttttttcaaaaatgatgcttcagaagtaaaagacagaaagcaggaaagactaattacaacaaatgaaaaggactcccattaaactttttaaaaaaaattatgaaacgtgttcttaaaaaaatattataatgttaggtttactatttaattattagattttcatattttaaaatttaatatttgatcatgatattatattaattataatttatctaggattttctattcaattaagatttattttagattttaactcgattatacaacagttggatttaattataattgatgtaagattttaataatctttgggatataaatactatatttcgataaattctaatcgaatgtaagtcattgacgaaatcataaatataatatcataataaaactattttcttaatatatgaaattttaataaaataagaaattttaatataacagtgattttttcaaagaatatattttaaatatttaattcttaaataacataataatccacgaatttttttcgtacaacactaacatttatgtcttgaattttcatactttgttttaatcaattttaaattcctaataacatggaacataataatttattattattataataatagcaataacaacgagaatccaaagattagttaatataaaataaaagtccaaactatttaatttctaaaaaatattacagaatttggagtagttacatatctttttcttctttaaaattaaacttttcattgtaacaacaacaaaaatattaaatttttcatgaaggataatgtaacatgctaagcttttgaaaagccccagctgtcattgttgtttcttttgttgtatgtgggccttaaaatgaattttagaaaaggctgagaaaaaaataaaggcattgtcccgaatgttcgagttagtcccaattccaaagcttccccaaccattattaagggtccattttttttttctctcttaaaaaagagagtaaaaaatagagtgaataaaaatgtataaaaaaactaaaaaggttttttttttttttatttgtaagtaggaattgaagacaggaaatgataaatttataataatttatgcatatttttcaattaattgagttaaatctttttagtgaaaatgttttatttttatgtatggttttaaaaaaagaaatataaaagagataaatagacaaataaacaagttataagtagagtaaaaacaattaataatatcacaacttttatttctctcccttctcattttcccccctactaagcacacttgtttcctatttctttatattttttttcttttctatcttactactgtttctttttcaccaaacagaatctaagagcatgttcatatttttagaatggagagaaataaaacaaaacaatataaaataaattaataccatattttattatttgtatacttttatgaataaaatatgaaacatcatcattagtgaagccggtaacaatgactaaaaaatattatcaatttaattgaaatttaaaaataaattatattttaaaaaattagaaatatagagatcgatgatagtttacaatagacatgtctggggagatacttcctcatgctccttaatttgtaaatacgagataattaaactttaaatcattttttcttaccaaagtcgagattagagtgatttttattgtatgttattgtatagacatcgaattccgactatgtgctataattgtaagacatatgaactgaagattctgattggttagagtaatgtatagatcaaaagagccaccctagtttttttttttttttttaaaagagtctgacaaatttaattatcatgtctaagtacatgcataaatggtatcaaattatatttatgagtttaaatttaattatcatccctatatacatgcataattagtgtcaaattgtatttacaactttgaaagtaattattatgcctaagtacatgcataatcggtgttttggttatttttgctacaaaccatgtttatctcttattttattatgatgcctaagtacatagtacatacataactggtgtcaaattctatttatgaacctatttatttatcatgtctaagtacatgcattattggtgtttataaaaatgttttttagtttaaatttaattatcatgtcaaagtacatgcataattggtgttttaattattttctattttgactacaagtatctttaataataagtaattctacgtgagttgaatatgagtcttattagtgataaaatctatcttttaaatatttaatataatcacatatttaagattaaaactcaaacacacttataaattgaaatattcttacacactaattgaagtatgtgtttgatagtgggtgttataggtatttaaaatgtgaattcaagtatttattgggtgtttgtgtggttcccgaaaaaggacaaaaaaaggtttgaaaagtagtgaatgaaaacaaagaaaaacagcaaataacgacggtgttgggtctggtaacagcgtagcagcttcaccaatttttggctggcaaacacacgcatgccaccacacgtgcacacacaccactatcgtattattcattcacatcccctttttcttccttcttccctttcactctctccctcccacaatggacctccatcgccggccgccggccgccgctgacgacggagcaatccgccaccaccccaagaagaggagtgacacttcctctcccaaggcctccgacgccctccctctccctctgtacctcaccaacgcgatcttcttcacgctgttcttctccgttgcgtacttcctcctccaccgctggcgcgacaagatccgcagccacacccctctccacgtcgtcactctctccgagatcgccgccattttctccctcatcgcctccttcatctacctcctcggcttcttcggcatcgacttcgtccagtccttcatctcacgcgcctccaacgacgcctgggacctcgacgacgccgttacagattctccctctccctctccctcgcccgcaattaccaaattgccctcacgggatgcctcaattatattatcctccgaggatgacgaggagattgtaaactccgtcgtggagggcgtcacgccctcctacgcgctcgagtcccgcctcgacgactgtcgccgcgccgcggcgattcgacgcgaggcgctgcagcgcctgacggggcagtcgcttgagggcctgccgctggaggggttcgactacgactccattttagggcagtgctgcgaaatgccggtagggtatgtgcagattccggtaggggtggcggggccgttgttgttggatggattcgaatacactgtgccgatggccaccacggaagggtgccttgtggcgagtaccaacagagggtgcaaggccatctatgcttctggtggggccagcagtgtggttttgagggattgcatgtcgagggcacctgttgttagattctccactgccaagagagctgcacagttgaagtttttcttggaggatcctctcaattttgataccttgtcacttgttttcaacaggtttgcttttccaaactctattgtgtctcaaaaatcaattctaactcacaaaatcatgctgataccatgaagaatggaaggaactatttgttgctttaccttcaccatgaattttttattttttattattttttttatttctcgacatgaagctataatccaaacacactattaatcattcaggagtcagtatcatgttgattaaaatcatgtttgaattcttgttatattagataaaatcatgttgtggtaccggctaactttatttttttaggtaaaatcatgtttttggttgcatgttgaagaattgattgattctgggtcgaaactcaattttgagttgaaacggttttataatggattttactactaatttggttttaatataaaaacaatcaaacataaatcacttcactttaaaatcaatttttgaccgaaattaattttgcaaaactaattttcttttttcttaattagcttcattcaaacatggactaagttaattttctgcagtttagggattaacattttttttttttttaaatgttaggggagaatcaaaggtatggttttcctttaaaattttgatttgtttgttataattgtgaagaggatgagtgaaggaaatatggtgtatagaggactggaatttggatgttgtttatgggagattatttatttatttatgcgctgagttttgttgcttggtttaatggtgtttcaggtcgagtagatttgccaggcttcaaggtattcagtgtgctatggctggaaagaatgcttttttgagattcacttgtagcacgggtgatgccatggggatgaacatggtttccaaaggggtgcaaaacgttcttgattttcttcagaatgatttccccgacatggatgttattggcatttctggtaatttctttccctttcccattttgatggatgagatttactagatctttctttctttccttttttaatttattaggactggatctttcttctgttaacctgaatgatgtcaccattcaccaatgccgtttactttgttatatgctactaatactatagacatcggctctttgtctcctttcattgacgtaattgtttctttcatgaaagtggtccaatcatattatcttaattctttccgtattgtttttgatgttttaacctttttttatcaatgttgtattgtactagtgtaagctttccgtatcatattgacatgttagcctatttttatttttattattatctgatttgaacaacttgtgtcatttaatgctgttattgtagaagttcgttatacatgtggtattttcaagttgaattattttcggagattgatttgtttgcttaattatgatctatgaagtatgaactatgaacatgatgcaaaaaattttgactgccaaactcttgcattcatcaccaatttatttaacttgcttgcatctcttactctcttgaatgcgttggtttatttgatatgatgcctataatcaagacatgctgaaattgttttaatgggaatattaggctgaaattgttttaatgggaatattagactgaaaatgtgatggttatgtactgactggatcctttaggaaattattgttcggacaagaaacctgctgcagtaaattggatcgagggacgtgggaaatcagttgtttgtgaagcaattatcaaagaagaagtggtgcagaaggtattgaagaccaacgtgtctgccctggtagagcttaacatgctcaaaaaccttgctggttctgctgtcgccggtgctcttggtggatttaatgcccatgctagtaacattgtttctgccatctttatagccactggccaagatccagctcaaaatgttgagagttcccattgcataaccatgatggaagccgtcaatgacgggagggaccttcacatctcagtgaccatgccttccattgaggtgatttgacacaccccatatattttcttagacaatactcttctataaagttggttaattttcgaattcaatagccaaggtttatatgattcattattgtgctcacaggtgggtactgttgggggtgggactcaacttgcatcccaatctgcttgcttgaatttgcttggtgtgaagggtgcaagcaaggagtcaccaggatcaaactcaagactcttggccaccattgttgctggatctgttttagcaggagagctgtctctgatgtctgctattgcagcagggcagctagtgaacagccacatgaaatacaacagatcaagcaaagatgtaaccaaaatatcatcatcttgaggtcaaggacgtggttgcagttattaattgtggactctagaataaaaaaaatgagagtaagcggaatttgggaaggaaaatggagaatcattagattagattgttggcatccacgtttggctctgcattgctgtctatttagatcttctattatttggagagaggaaagtagagttatactctacatgttccctgtccccttctggatccttccttctttcctgtatacttttcattgcttgttctgccgagccattgagtgggtgttaacactcttttttctcctcaaccaagacatttgacgtgttatattctgattcgtttcccctatataatatgcttatcatatctatcattgtagccgaatgggttgatgaatgttctcttcttgtccgctagtccccgtcaattaaacttgaccttatctttttcatgatttactaactcttgtcctatatatatgattttctttcaatcactttataagaattaaaagaatgtagctaatttaattagtaatagtactaaacttgtcaacgatttttctttcagtattgtctctaaaattattgagatccctttgttttaagtctttatctaactaatgaatgtatttctgtttaagggtaattttgcaagaatgttaattaacgcaatagataaattggggaaggtcttataaaaaggatttagataattttacaagagatttttgcaaaaagcactcgaggtagtatttagtttatttgcacgatagagaccagagatttttgccattttcattttctgttcaaactaagatagatgtttagcattggtgttttgaggtatttcattggcaaaatgcttctttggtattcaagcataaggatcatcactcaatcatttgatattcgcttatctatgttataggatgaacttctaaattgagctggaagtggagctaagtccagaggactctcgggattttggccataaacagcttaatttttttaaaatagttagtagataattatgtttttttgtcgtgctattcggttcctaactgtatatatgaaaaagagttttgttccaagtgtagaatttacttcaatgatttttacactttaaatgattgtatatgttttcaattcatgtaaataggatactgtttacttttagtcacttgaaattaaattaacttgttttgatctatcgtttataaaagatgctacagtaatctttattttcatgaattaattaacttattttgatctatcctttataaaaaaatgctatagtaatctttattttcataaattaaggagaaaaaataacatgacgataaaattgacttcacgcgacccttaacatactagattgactcattgcttcaagcccaacatgttaagtattgtgtgaactataaagttaacctcataaacatggtgatggaagaaaggggacctagcagagtgctcccccttgggggccatcccctcaatgggagaattttcttcccattttagatggattcctttctctccatagtgatagtttttttttcttcttcttccaccttccctttctacctcacaaccacaaccttacttctttttaccattgccttcacccactttccttcctccatttttagctacccatcttcatccctttttctatttttttatactggataaaatacccgaccaagccgagggaacacctggcccatccaaatcgaacacatcccttggctacgtgtatccatatatgtcgaacaatatgtctcgatgtaacgccccgtatgcatccggttcattaacattgatttatggtcattaagcgcagcaattatcacaaataattaaatttggaagcgataaactaaatgacatcatcaagcgtcattaacaaccactgtacatcatatatggtgaattcttataatatacaacgtatattttaaaactatacaaaatccctatcaggatacaaaataacaggcatgtatcaaaagatagagccaacatgctcttaaacactatgcttaaggttttcacagaacctatccctgctcgggcctcttgccctgggatctctcagcagctccctgagaatcacctgcaaaacataacccccaacaggggtgagataacaatctcagtaaacttagggtccttggaggtctttcctccccctggttcacttccatggcatataatatcaaaattggcattttaaactagtaatcccagctattaagtcatattaccacacatacatagcatatttacaattatgtatcaaggcctgaggaggcattatccactatgtgggcacatctcacttggaggctcatccactatgtgggcacatctcacctggaggctcatccactatgtggacacatctcacaacaagactttcatatatatattctatcaaatataattctactggccagagaatctcatcaatcacatatacaacactatcacagtgtttaactcatcatatgcacatgttcataaaacaataatcacacaatttcaatatacatgcatcatgatatacaataaccatcactctctcggagtatggtggaacacaacagtgggaaacactcccaagaacaaagagcttacctgctgtcagcgctataccggctctcccggcttcgtggtcacaaccaccagcaagattactatcacgccctacacaagacataaaacaatcaatcaataacggtccttagccgttagaatgaaaggaaatgtcattcccttccattaaaacctctctgttctctatcttaggattatcagagctaaccaccttataggtgattcacagaccctcaacaggatctatcttggtccaaccaagatcctagagttcccttagactcgacataagctcaattcaatgatctactaggtcatatatcaacaatttcccaacatgactaaaacagatatatcaacacattttcaccgtttatttatccttctgaacaacttttgtaaagacacttaggctcataactatcataatatcttccttttactcaacatttttcctacccatacctatctcagggtcaaaaccaaacttcatcaaaaatcatgtttcaaagtttaatattcatcagaacaacctcctgaacatacttttctaaagaactcaagcttaattctagccctatcacaaaatggtcactattcatcccaagaacaatttcacaaatcaaacggtaaaacttgagttttttacctctaaatcgacagaaaaggctagagaacaacttttccaagcttgaacgtccttgaaccgccttcttttctcctcagaatcaaactttgtgaattttcctagagaactggatctctttgtttgatggttttcagagaaaagtgatgatggaatctagctcattgagtagttcctttcaactttcatgttgggtgtgaaaggttttggtcaacggttgagtgtttaagaagcttctctagttcatcaatggtagaagcagagaaaaggaagaaatgaaagagagagaagggctaagggaaagagagagagaaggctattatactcgaccttcaacatgtgcaagcaatgagtactactcgatcgtgattatcaccactaaacccatttaagggtgatcacttgactgaaagtgtctaagtatgatcagaagaaatattacttaattggtaatcatgatgtgacaaacacacagatctcaggtccaataaggttattataaaaagtcgtgaacccctcaagtaagaggactgattcattctcacctactcactacatatccttaatagctctgaatcaaaccttcactcgagcgtcaaagtgttttttgcaagtactctttcatctgttttccagacatgtaagcacttgagacctcggtaggaaaaaccaaacagacaacccttcaacacaatagaagaccgttcgataaaaagatagatatatgatgcatttgtgacattgaacatttttttttgtgatttttcctatgcctctcttttctttgtgagtctttttttggcaattgaagccaaaccaccaaaggtttttactacttacgcaacattagtcagctttgttgcttttctacgaggttcttacataacattgttctacttagatttgctgtgtgttgctttagttcattactggttgacaagtggcaatctggaagggactacaaagaaaaatatgtagaaatgtctaagactctatgtttttatatgtgtagctaatggccgagcgtgcgtgccagttttattgttgtttatttgtggtgcattgttgtaacacaatgctccttgtacattatcttgagtttgtaggtgtcttttgacattttcaattaatgataactgaacagaaaaaatatattatttgtgtgaagtatttctattaatttttctatttacaaggcattttttcttataatttgtgtcatgtcagacatataaaagaggaaaatatttttttgaaatatgtaaaatgctttcctacagtttttaaatgcgcttttatatgatttccaataaaaaaaaattcattttttaatttctttaactagtgtcctaaaggtaagaacattcgtcagtaagacacattaattaatactatctagtcttttttaaattattatattaactaattttgaatgttaaaattctttattgagtttgtgtataaattatttatcctatgtttgaaaaatggttgagagatcttatgtttaagggttgagtatgtaagtaagttaaatacttaaaaggaagttttgttgtttagagtaattttatccgactcttgtttccgataaagaatacatgtgctatatatatatatatattgtccagtctctatacaaacgttgagttttaaagatgatgaaggacttgctttgaacgtatttcagtcctttgtaaatgggcccaaatatatcattaccttttctttatcacaacacaatattactcttttaattaaacatatgatcagagataatatagtttttaatataattaataaaaaaatcaacaaacttaaacatattatatataacaatttctgattaaatagcaatgtatatctttacacgatttagcacttaaaaatcctttatacaccaaatggtcatggttgtaatatttttggaaggatagagaatgggctgaaggcccaaatgtagataaaaatgaaatatcggttcgaaatagagaccagctctaaagaaatctcacgttcactgcgagagtaggagccagaaaactgctgcttctcgaagttcaaaacttaaaccctagttctactctctctctctctctttcttctgcgtcttcaaccatgtcagcgatgctggtaagttcattctctttctgctctgttatgtgtttccataacctaacctaacctaactcgttgctattggaaatgatgtgggatcaaacagcaacctcagatcattctgctgaaggaaggcacggacacttcgcaagggaagccacagctggtgagcaacatcaatgcctgcaccgccgtcgccgacgtcgtccgcaccaccctcggccctcgcggcatggacaagctcatccacgacgacaagggaaccgtcaccatctccaacgacggcgccaccatcatgaagctcctcgacatcgtccaccccgccgcaaaaatcctcgtcgacatcgccaagtctcaggactccgaggtaactttaacttcccttcgatctcatgcaatgccacttctttcaagatcttttcattttcgcttcattcagatgctttaaactttggaattggaattttttgttagtaaatgaactcttgtattgttgtgaatgtgaaaaaggttggcgatggaaccaccactgtggtgttgcttgcagctgagtttttaagggaggccaagccattcattgaagatggtgttcactctcaaaacttgatacggagctataggacggcctgctccttggtacagagctatctccaattttatttatttacgccttgtttgaataaacttatatataaccgtttataggagaataagttaacaagctgaaatgaattgagtttctctcttaagttaaaattaacttatgcactttaacttttgcaaaagttctcttatctaacttctccagatgttgatgtgcagaagtttattttagcttatgggagaagttcgattcattttaccttttttattttctcttataagtgcttatggaaaagtttacctaagcagggcctggccttaatttttcttttatttttgtcttaaattactgttgaataatgtaagtggaagtatgttcctgatttgtcacattacttttgtcttgttttatcattggtgcaggctatcgagaagattaaagatttagctgttagcatagaggggaaaagtctggaagaaaagaaaagcttgcttgcaaagtgtgcttctaccactctttcttcgaagcttataggtggagagaaagaattctttgcacccatggttgtggatgctgtaatttcaattgaaaatgaagacaggttgaacatgattggaataaagaaggtacatgtgttggttcttttgcaatcttgtatttgtgtgctgcattctctcttttacattggtgattgtttgattgtcctccacattaacaatagtgctcattaaatattttcttcataattgtaaaatttaagttgatttttttaatagatgaattattaataatacattgtcatgagaaatgggtaatttagttcaatagtcactttctctctctctagattttaggataattattagtttccttaattcttgtgctatactctaaagtgacaattatttgagaatgagtaaaaagcatcatagtgcctccctccccccaaataaagcctgcctagtttttatagtattgtaattagattttttgggcttccacttcccttcagatatggtaaagtagatgtgttatatttgttttccatgttctataataatgttttttggaattttaaatgtgtgcattagtatttgattgcccaaatgatgtgatagaaagtacaaacaatcaactaaccaaaatggttacgaatgaagatcaaggagtgttactgtcatgcaggattttgtttttatggttaaatgtttaattacatgttaatcaattttgtgttagtgtttagaatttttttgaaaatcaatcgtggagactcaggttttcttctacaggttcctggtggtaccatgcgggactcatttctagtaaatggtgttgccttcaaaaagacattttcatatgctgggtttgagcaacagcccaagaagtttctcaatccaaagatactattactaaatgttgagttggagctaaaatctgagaaagaaaatgctgaaataaggtatttttaatttttttgttttgtttgatgatgctgacctgggatcttagtgaaggattgcataccaaattggaaatcattctttttttcttgttctctacaggttatcagatcctgcgcaatatcagtcaatagttgatgcagaatggaatattatttatgacaagttggataaatgtgtcagcagtggtgccaaagttgttctttcacgattggctattggtgatctagctacacaggttttaatcattttttttaattaaatctattttttttcatattcttggatttctttcaagtttcaactacctataaaatatccaacgtttcttttaagtaaatgcaaagtgtgctgtgtgccacctcctcctaggatggtttcctggtacattttatgcattgtctcttatgtaataatgagcttttattcatttttgcattttctattctgcatcaacctgtttacgtttaagtgtagattgacacccttattaattgttcatgataatggttgaaaattactccttttactgtgttaaaaactttcagggaaatcaactataattagtttttttaataaataattttcccttgaaacagtattttgcagatcgagatattttctgtgctggtcgtgtagctgaagaagatctaaaaagggttgctgctgcttcgggtggaaccgtacaaacatctgtgaataacattattgatgaggtttcacattacttgtgtaactctgtcgtgatttgctcattttctgtaattttatgcattacagatgaacttcttgtgatttatttgcttgaaggtccttggaacttgtgaaatttttgaggaaaggcaggttggaaatgagaggttcaatattttcaaaggatgtccatctggccaaacagccaccatagttcttcgtggtggagctgatcaggtctgttatgtgctgtgcaagaactgtttatgaaacttgtagttgaactcatgtaatagctctggtaatcttgggcttatatttgatatttactattttcttacagttcatagaggaagcagagcgaagtttgcatgatgcaatcatgattgttaggagggctttgaagaattccacagtggttgctgggggaggtgcaatagatgtatgtgtctaaaatttgtaggtagttatcactgaattatattagtcaacttgttggaagttaatatgtggttcttgttggtagatggagataagccggtacctgaggcagcatgcacggacaatagctggaaagtctcagcttttcattaactcctatgcaaaagctcttgaggtaactgttttggaatttggcacaatccatagttgtggtctttttatgttattctagtattttattcattcaactttgttagtaactcgaggcaatgcctgtttgacacacaagtggttttgttttggcactaacgacgatctccatcaagaacttctcagcttaatggtcttaagtttaaactaataggattcctagctattagcaatgtgtttctttaatgttgttttcttccaaatccaacgttaatgccattaataatgtgtctggtagtcgatccatatataacaatgcatagcaattctggaaaatcttaagggtggctctcacttctcagacattttatccaatgatgaggaactgttcaatcatatgtctccttactgtattactattggggaagggttgggagaaaaatcctttgtgcatgtgttttacatggcgcaattcaacctgaaattgacacattgatatgttcctttattttaacattgtaaaagtagaagtgctcattgcatttgactatttgagacattaattgctgtactggatgttggaggtctgtgagcatgggattatcaaatgacgtcttttagcaggctataactttttcacattagatgttttgaaattgcatccccaagtatttggtcttgcatgaatacttagggtactgtaagaaattagacctgaagggtatggaatcatgttcttccactcagagtatacttgattgtttttttatgcaaagttatggtattactgcaggttatacctagacaattatgtgacaatgccggatttgatgcaactgatgtgctgaataaactaagacagaaacatgcgcttccttctggttggttggccatctttttgtatgcatgcagtgtgcttgtttacactttacatagatgtattttatgattacttgcatgcatgctggcatatactcatttgtctgcttgttacaggtgaaggggcaccctatggggtggacatagcaactggtggaattgctgactcatttgctaactttgtctgggagcctgcagttgtgaaggtatctgcctgcatttatttggataatgtcctgattctgatgttttatgtgcatggtgtttaagttagttaacatttttgcagatcaatgctataaatgctgcaacagaggctgcttgccttatcttaagtgtggatgaaacaattaaaaatcccaaggtaagtttagttctgttattgtatattagatgaggattgtgcttctgttcataacttatttcctggagatttgcacaatttgaaggaatattgatttttattatcatattatattatgtattttctaatttcacgttagttatttctctgtttggtcttcatcttttggtcagggattttgtattttgaaagggtaatgctttataaatttacctttggatatgtgcagcagcagcacataaagaattctctgcacaaattctcttgcaactcaattgttttacacttgtctcttttaagcattgtacatatatcactatgcgttgaggaatgagtactagtttcatgcaaatttgttgtacttgttttgaaaatggtatccgggtctctatcgattagcatattgcgtgggaatggtatccgggtctctatcgattagcatattgcgtgggaatggtatcctccttctactccatgtgaatggggtttccatggtttgctaagggaagagacagtaagggcttcattcctcatctgaattctttatagacaggaatcaatattctctttattggagatgtgggaatgccgttatgggtgggacctatgggatagagattttttgtttcttttcctaacttaaaatgcttatgcttttacaaaatgacaaaaaaagttctctcacacgaggtacccaaattttttagtagttttacaaaaattgtgcccttgccttgtttcctgtcaataattattatttttaaagtttgacccaccttagttggattgagtgccattgagttttaatgcaactacattccctatacttgaacttgagataaatggttaagttagaagttgtaacctattcaagggacaaacagagagagagggagcttgtggacaattttggtattgttgcaattgttctacccggatctatcttgtgactatctgaattttacattgattttcagaaatatgttatgtctactaactagatcctcttttattcttaatgtaactagatcctcttttattctggctacttccgttatgcagctgattttgattttgtctatttaacatctgtagtctgaaagtgcacaaggagatgctgctgcaagtgccatgggcagaggtcgtggaggtggattccgtggtcgtggacgaggaatgcgaagatgatttgaagtgcattctacgggttgagtgtctgttttaattcgtgaggccaatgcatgcttgtttcttctacttggtgttgctggaagcatgccgatttttggacctacaaatcatgaaatgaaaatgtaatggagattctgggaacatcatctgatcaacctaggatttgcagatagcaattttcaagcattgtctttctgacgatcgttttatacattgggaggggttaaaactatcgcatggctgtggaggacttgagttcgtgtgaaatttggaatcttgttctacaattttcacctatttatttattacttggtatgcgtatagtataaacatgtgatttcaggtttttttttttccgtctacaagtcatcagtggggatgtgtacgtatatgggctactaaaaaattgatattcgagtagttggttaccgtagtgggtaattgctctcactcaaaagtaagggcaaattattgtatttaccaagctacgttaaaaaaaaattgaataaattattgagcacacaaaaatggatttatggttcatgccgtgataaaaatagtagtaacatagtattataagagaaaaaggttatgcacggtaaaaaaaaaatgagtcatttaatcataatttttatcaataagtttcttaattttttaaaataattattttaaaataatgatttatgattgaatgataatttaaatttattttacaatatcaatgtaattttacactatcgatatgaggttaaactcttattataaatatacttaaaaaaaataaattaacaataaatagttaaacttttatttcaccggaaaattattacgttttgtaagataaaagattgaggctgaggattaatactttatgtatggacaatccaaggagttcagccttgaagtttgtaacaacgccaattctagcttcataacctcgtgctagacaccatatcttcatagataccattcatgttctaattcattaatcatgggattaaagcactagatttagattagtccttgaaattaagttaatttaattcttaattttataaaaaaggaattttagttaatgacttttataactgtcaatcaatttaattcttaaaattgacgctatcaattaatttggtctgacattatagaatcaatttttttttttttttataagctagaatcaattgaattaatccttgaatttgacaatcataattcataagttcatttaacctctggtattaggaaccgaattgactaatgcccataaaaatcaggaattcaatgactataatgggaaatttagaannnnnnnnnnnnnnnnnnnnnnnnnnnnnnnnncccccccccccccccccccaataattttagagattaaagtgactagtgattataatttcataaactaatctcctgactcctgtttatactctcttgcatgaaaaatgaaggtcggttgcttacctaggaaggccttctctataagtgaaagacataattgacactcttactttagacagttagagcatagcattggctatttgacagtttctatttgattaaaaaattagttgaatgaaaaaaaaacaaaattaaagaagctacaaaacaaaataaaaaattgttaggatcttttaaaaattcgataagaatcttgatagaaccatacacaaaagctagttattgaacttgaaagttcaaggccttataaactttatactagaatctcatacttatatgattcagtaacaaaaaataaaaatgctattgtatatgatctattagatttaatagaagaaaattgttgagtacacaatttagatatagattaagcttagagataaaggtttagactctagagagtaattccagttgtacacactgaagactggtaataaatcaattcgtagatggaattgttatgattttgctatttgtatcatttaaccctgggtgtgaagaaattggccatcgcggattttcttcttctgagttatatgttgtaagaaaacaagaactaaattattacttatcctaattgtgttgtcaaaatatatataaaaaaaaaacaacaaataaaaattagagaaaaaatatttcatgattacaatgaattaacaccccactacatgcgagaaccaaaatgttagcaatctttaagtatgaattgcaaacaacgaagctattagcagacagaagatataaatgcacataaacttatgtcatagattcagtcgaaaaagtaaagctttttgttgggtcaaaggtttgggctaagaaaaagaatcaaggtctacggaagaggatttatcaaggcacgactttatacttcatgctgcaaatgaaaaaaaaatactaataagcatcagacaccctaaatgaggaattttttgtatgaatcttccttcacatttatgacagctggcaagtatttttttatttttatttttttgaaaatgagaaaactaataaataaggataaaaactaccaaaggagtatgtactacatgagcatcgaaaatttgttcctaaatgtggaggaagatcagtggttttgactcttgaagcctcaccattgcatagtgtatgagctacaaaattgaacttattttctaaaatgattaatgaaacattggagacagtaaaaggaaatagctaacagaaattaaacagcaacaagatgaagattttgaagaaacgaagaatcctcagaactacaatcttgaaatgattacaaatattctgcagaaaactgattcagtaatttggcaatttacttcatagtcaaaagcattgcaagacaaatccatatctaataaaaagagatcacgaaaattccattatgctacaatttaaatctcagaatcctgtgagcagagtggtgacttcatcagttgctttggcttctacaggaatgggggcaatattacccatcgacgaggatacctaggtctaccttcctttccatcaaataactgcaggttcatcaaaaaagataagacacatgattcatgattataagatgcaaaaaggggaagagactagtagtatgtttgggaacacgttttacaaccaacaaatcatgtccttaatatgaaaaaaagagctattagcattcattttgatgtgaaaaaccacgtgcttgatccgtctctaaacatgctgtaacaatattggttcactttatagtatatgatatggtttcaccccatacaaatgataattttataaataaataaaaaatgcaaaatccatatgtagttgaccttggcataaccaagcaataaacattatattcttacaaggagcagcatttttgaatctccatgtttaacatagaagcagaagaaacaacaagatggtgtctgaaaatcaagttagccacaaacctttgaaatcctcaaaatctaaaaccagacagtttaggaaaaagcacaatcaagttattcctttacaagaaagttcaggtggagtatataatttgctctagatattttttctaagactgtaaaccatattagtgagctgaaactgaaatataaaaggtaaggaggcataccttctttaaacgcctgtgcttggctaaagcccaattggtcatgataaaagtagcaaccacaagaaaaatatagcctgcaacagtttgcgttgcaatgttgaatcccaaccactgatagatctcggttgtataatttgcacaggtaacaatattgaagagaaagccccttgggatttggtatccaccttcaccaccaggactacgaagattcttcagaataatatggcaatagaaatttgaaatttgacaaagtatcccaattccaaacccaatcttcatttgaaggtcgtttacaggggtatataaagggtggttcacataataagcaatataggagccaaaggtccagtaataagcacagttacgaaacacattggaaaggggtgaggttgcatggctgaagcgatgcacaaaaaatgtttccagaattcgtttggcataatggaaacaccagtagtacaaggcatatgtctgcacagggtggaggacacgttcacctttgtagccaaaatattggtagacagggagataatagaagactggatagagaagcaaaggtcccaaatactcgcagaagaaaagtgtacggtaagaaacttgtgggcccaaatccttgaatacaacagttaaggtttctgaatttccacttgtatagtctttcagactctttttgtaattaaggacaacaggcctttcctttgatcccggttggacaggaagtgtcaagcgctgccttgatgggtgcttcttggctgtaagtgaaacatacaaatcatattaatgatctatgaaatccaatggtgcctagagacacagatacacttacagatcagcatttttttttcttccaagagaggtactaagatggaaagacaaagccatacaatagtagcaggagttgcatgcaggattgaactagtgctgtcaccaatatttcattttatttcaccacccaattaaaattgggttatgttttcataagctgaggaacattcaaatatttctattcaacttcaacaacctagaataggtttaactataaagctactgacaaagacttggatctataatctaataaacaatactgagactcaatgctactaggttatcatgctgctataatcattaaaggatcttaatttatgaagcccagatactctaaaatagcaaatgtattggtgtccgacatgtacccaataccaaaatggctaaagatactgctgagaacctcagaatacagtttcatttcaaatagacatgtagtgtattttttttgttaaatttcccttcatgtaggttgttccaaatcgtgttgcaaaaaggagcccccatcaccactaaggcttgcaaacagcaagtccaaaaccaaatgcatcttccttctcatgaacaatctcctgcaagcaaccatctgcattgctgaagttgctggtggttctagctcctctttggttctctctccttcgctgggtgccggtccgtgttctccaagttgttattgctattgtgcatttttggtaatgtatcatgttaaggtggatgtgtagatatacgaagatggataagataagaaatgaggatattcgaagaaaggtatcaatgatactagtatgtgaaaagatgagagagcataaattgaggtgtggtttggatacgttatgagacggccactagatgctcccgtaagaacaaaagtttgttaccaagagctcgacacaaaaagaggtagaggtcgaccgaaacctacttggggaaaggtagttaaacaagacttaatggagtgagatatagattggcggacgctatgtcttaggacggagtggagaaaagctataagcttggtggaggattaaactcattagtagttttatgttccagtcattcccttgttttagttcttttccccttttgtcttattttcacttttttctttccctctctttttctctttttgtctcatttacgatttatcattggattcatctaccaccgaccccaattacttgggttaaaggtgttgttgatgttgatcatggttttgtcctatcttgttttttttataaaaattttgtatctgtatatgtatcataaccatatcatattatgtatctgggattcttggatcttaataaatactatatagtaagaatgataaacgtcaatgaacatcaggagctgttatcaattatcacatcactcagtgtaaaaagttaaaatccatcacaagtaaaaaacaactaaaaccacatgtacaactaccttagtacccttatacgcccaagactaactggatttcagttattttacatctcagacattactttaaaaacaaagtaatttatacataagcatagtagagaaaatgaataagttcacttacttcgcttatgaattgcctcctgcagatctgctacagtagcctacgcaaagaaataaagggataaaccataaattattactcttgaaaacaaagtccccttttgccaattgaaaagatagacaaaatgaagggaaattttcggccatatagataaaacctatctatccaaaatcaatcgagatatcaaaatccaaaactaccatgacaacaataaaattaacacaaaaaagagagtaaaaaatttagaggaaaaaaaaaaagacatacagaatcgctgagctcaatgccacctttaaccacttctcttccactccgagaaaccactgtgaccttcatctttgcgaatcaataaagggttactatatgcaagatccaacagaactaggggtctgaaaatagaaaaaacgaagattcacatcagcagccaaaaacacaatgcaaggagtgtgattttttacacgaagctattaaattaacaatcatgttaatgtagcagaaaaccccacattaaatttctaataattatggcaaaacaatcgtcaagttccaagcttttttatttatttagtaatagtgtggaagaagttagcaaaagatacgaactttgacgaagaaagtcgggattcgatgataacagagaatgtgagtcacagcaaaattaggcaaaaaaataagaaaattaacaaaagctcgttgctgagaaatgaatgacccaattggaggaaaagaagtaaggaagaataaaggggaataatcacctgaattggacagagagaggtggtgttggtgtgtttgcaagttactcgcaaacacaaatgaaatgtgagcttaggaaaattgaaactcagatgtaatatattatatatagattttagatgggagaagataaattaatgtgaagtatggtcaggagaagatgaagccatgcatatgcatacattaatgtgatgcagttggggttggacagctaaccgttttggctgataatctataactcaccacacattgtaacaacgttccaattggttttgtgttgttgaaattgatggtgaaaaaaattattttgaaaaaatatatttgtatttgtgaacaaatgatttttcttaaaaaaaagtgtcatttttttatggaataaaaatgaaaatataataatattttttattaatttatgctcagaataaattattattaatgaaacattaaaaattcacacttctcctaaaaatgaaaaagatagattaatgtttcctcttacctttactgtccaaccttattaatttatgctcggaataaattcttatttcttttatagcattttgctcaaatggttggcatcgagttctttgcaatggttaccttgatcctctttttctagtatctcaaagcctagtgtatttggtttggggagtgtaaaatcatactgaattaattcactacaaaagtaattatttgttgcttctaaaagttatattaagttcaattcaccaccaatttaaacacatactaagagaattattgagtataactataaaacatgtaaaatccatactagatcttacaaattgtacatcctacctcttccttgttgatagttctcccctttctcgttagaatattttgataatacattttggtctctttttcattgtttcagagtttttgtaaaaataaatatttcactactttctttcaccatgtatgatgagtaaagtttaaccgataaattgtatgttttgtgtatttggatatctatttatacatctttgacgtacattaccgaaacaactattaatgattttttatacattttgatgtgataatttactaaggcacaaatgataatttagacatccatgaatcatcactttgtgtaattttactaaacgatttcgtacaaaatagtgatactgctttttaaaaattagttctacttaatacaaaactaattttgacaaacacacacctcaatatttttagcgcaagcttgcatttgcttgtaacaaaacaacctacaattcatccagatttgatctttccatcttattatttttgttgcgttagaatttttttttttttaatatactttgtgtaaatgataatgagtttagtatattaatttaattttcgttttttacagttaattcaattttcttataacatgaagaataatatgagagaataatataaaaaaagttaaatgtatgtttattttgactaaaaaaaagattatatttttatattcaaaaatttttgtccttgaaaatttctcaaaaaccaaaccaaaaggaataggcaacaagtacatatgtatggcccatggcagcgcgtctcaaaacagtagttggatgatgaaatggttgtgcatttactaactactacctactttattatagtactcaggcttctgcctaattaaattattgtttttgtatgcattttgtttacctacaattgcctaattaaccattgacttcgtgacttgttgttttcttttggtcagtggaggaagggaattgagaaacgataaagggtccagtgaaaattcgaaggaaaataattggtattcactccataagctgtgtttttttcaagaaaaaacaataagaactaagaaggatcaaatttatgtttcttccatcgtttagattgcttgtaaaatggagagaaagagttaaggaatttaatataattagttaaacaaggtgtgagttgttataaattctttacactatttttaatttttacggataaaacaaatggtctgcccaagattaaacaaagaaagagagatgagaagaaaattaaagtcaaagagatatagaaaatattgtttacattacataaatatcattgttggaaattgaatcaatctgttacttttactaagcaatgctatatacaattgaaaataactcccgtcacaatttactattgagttgaaactgaaactgatgctaaaaaatggaaaatgagttgttagggttgatttgaggtgtggcttgcttttccatcttttgaaacaaacttggcaatcctatcaattgttggccgaactcaaatttcttaacttcctattccaaactactagtactaggtaaagccgagtagagctgctactcaaaccccgttagtttttttttttttttttttaatactttttggaaactacttttnnnnnnntttttgttaataatgaagaatacattcaaaaatgtatcgctaacattctttagttcccttcttgatacaaaataaaaataaaaataaaaaataaaaaaattctcttttgttgtgatcattctttaccatagaagtatagatttctagtaacacaaataattatcatgcatgcattgaatgtacatgatccagtaatattattatagaaaaaatgatgaaatttaattgatgtagtgataaattcttcaactatttctcataaaaactttactagtattttcataaccatttccttttcccgtgtatccaagtttgtttgacatttgttgtcttaaaataaataaataaatgaattgaatgcaaatgatttttttattgaatcaaattagatttaatattatactcaaatcaaactgaatcacaatttacttttatgcttagattgaatgatcttttgttctgaaaccaatccaaatcaatttatgataacccctggcctacttattatcttgttccaaatcacccaataccttttattaaacacaaatttgtttgagcaacgtcaagtataagaagcctttaaataatcagtgcaaattctggaaatgatcttcatatagacactgtcaaagactcagtcgtatgttaaagattggtgagcagtttatgacaagtatgcttacacaagcaactttattatatcattcaaattctaaattctaaatgcaacaaatcacagagccttgggtgataaaatggttgtaacaagctcatccattgctctcacagaagaccctttttctttacctttctctgttttggcctctctaatgtaagctgcaatctcatttgccttctccttcatctcctttcccttcccttcataatccataactatttctattgtcttcttaaccttctccctagaaaccacagtttccgtagaacgagtaagttccacaaccacacccatttcctccaccaacatcttcacattataaggttgatctgcaacaattggccacccaatcagaggcaccccatagctgagactctccaacacagagttccatccacaatggctcagaaaagctcctgtggaagtgtgtgacagaatctccaactggggtccccatttgtgcaccaaaaggccacgtctggtgtctctcattctctcttcaaaccctttggcaaccattctgcactgaactctccattgatgtcaaaaccagcaggtggccttataacccaaataaacgatttcccactctcttccaaaccctcagccaaagccatcatttgagatgcactgatagtgttcagtgacccaaatgaaatatagagaacagaattctcgtcctttgaatccagccactcaatgcatgcatcaagagctatgccagtttcctttcctgaacgatgttttgaacccattagtgaagcaggtggaaggagaggccccacggcccaaacgggaagttgaagatagttcctcagaagccttaaccccaaaggctctatcctttccatcgtattgcaaatccacccatcagacttcatagaaagttgaatctgtggaacgaggaatcttgaccaatcatcagtgccatcagctgcttgaagaaacctatgcaattgagttctgtggaaacggtagttttgagggaaacccggaacatggaactcatcaggatcagttttcctatgagggaggttggaccagatagagatataggccaagattccataagcaccacaagtggtgaaggttaggttcctagtgcctaagctctttgcaacattgttaacccaaccaaggaacatgttagatattatgcaaagtggagggtgaccctcttcttgtgtgatctgtgatatcaaggagcgaaaaggaggctcaagggtgagtgatgcatagccaagtttcaataggtcagtgagaggagccttttgtgtgttgttgtctatgttggagtgttgggtagagttgaagggtactaactcagcaagatggatttgatgattaggagaagtagaagaagaaagtgcagatcgaaggtgttgaatgttttggggtgtgttggctatggtgatggtgaagcttgtgttttgttggatttgtcttgctagtgcgagaaatgggatgaggtggccttgtgccatgagaggtaccatcacgatgtggcctttgtttggtgtctctgccatgggagcgagctcgatcgaggaatgatgtgctacaccctgcgctgtctgtggtataagaacactaaactcaactcttgttgtcttggtttctgctaagaagtgtacaaaagaaatagcaaagagccagagatgatgaagtaacgtgaaactaaagaagggtgcaacataaagcaaaaagagccaaaaaaaaaaaaactatctgaatcaatgcactcaactacctatgcatgttgaactagaccagcttttcgatgctgcgggacctgacctgactacccaagaagggaaagaaaagttataaacattagaaaaactagaggaataaaaaaatgcatgttggccatttaagatggattgggtggaaaacaaaattaaaaatagtataatttacttattaactcctaattagaattattaactaatctccaacacagttgaatcaaaataattaatttgtaaaccaaaaggaaatcaaatattgctattaaaaacttgagggtctaaaatcctaaatttaaaaatataggagattaaaaatgtgatttagcctaaaagataatgactcagacaaagatatttatgcacactcaattttttttttttgaaagaattttttttttttgtcctacagttcatctcaatttattattttctcttcttttttcattttttcatctcaatttttatgtgcacttttattatttgttgcccttcgtgaataggaaatattttttgaacacaaaaagtgtgtaattcaatgttactgcttttgtaaaatatatactgtaattcttttatattattattcaattatatattaaaaaatgtgcgtcaaatttccttttaagggggaaatctttgaacgttttagaataatccatcatgttggccttagtatcaaagaacttgaatgcttgaaagtgcttcttccagccatgaaaagtttactttttaaacaaaggaacaacttagacggacaattaagacatgatttcaatgattactttattattactatgatctatagatagatatatctatatatatctatctatagatctctttataacccattctagctcattgactaagttcggtgactagcattagctactgtaaaaaaaaacaattaaaaaaatcgaataaaacacgaataaatttattaatttaaatatttaattaaatatttaattaaagaattttttttttttttctaaaataaatgatttgaatttcattttaataagaattccatttttttgtttgatttctttttttataaaaaaaaatgaatatatcaacgcatagtaaaaacagagctactattttggatcactctcgatgggtttagacttacattaaatggaaagacaatgtgttgacctaatacctaatacacgtcacagatcaaaaaccttatgagcctacatcaagttgtcatatagcacatgagtgtttatatataatttttttttaaaacaatttatcatttctcatcacgtaataataactaccttaacttttataaatttaatagcacttattacaaatccaagatgcttgtgaaggagtatttatcttataataagttttaagtaataatatataaacatctcatcattttaaatatttcttcaatatctctttttttttaattttttttctttttatcacattataaatcttatcatatttatattatttttttttatttttccctctccttaaatgttaaataatacaataggtgtctatgcaactttcataagtttttttaaagtttgacccccctagttatacctcttttggttccattccttgtataaatggttccctatctcttgtatctctttatcaatcaataatactaatctgttttcattctttctgtacactctcttcgagaatagtaaaaaagtaaatctcatcccatccttggatgtaacattatagattaatagatatagatagattagatagacactataatgattatattggatattgcaaacaagaagtgcagattttgcatttgatatagagatcgagaagggaaagtaaacaattctgaacagggaacaagaaaacaggaacacactggttataaaaattcagcacttttgatgatataagcgaagtagtaggatgataaaagaatgaggaatgatatatctaagttatcgactatcatttattttaaatgtttcattattatttaacattttttttatctttctcatcttatcacatcataaattttattaaatttatacttttctttccttttctgtctctcactgggcatctaactcaaaatattttcctataacaattcagcaattatgtcaatgttaatatttgataacaaaaaatttaaaacactcaataaacaattcttttttctctttatctctctttatattacactacatcattaattaaataaatcgcttatctttcatctctttctttctctctcagtaaacaatttaagctacactaacttcatcctcataattaatgattattatatattaaaagtttatatagatacgtgtgcttgctgagatcatattcattcaccttttatgctgaacttaaatcatcaattaaaatgagttaaatgattatcttcatagtgacaatattaccaaagtcttgtgctaaagcttgctgagcagtgcataacaagtatgcttacacaagcaactttattatcattcaaattctaaatgcaacaaatcacaatgccttgggtgataaaatggttcttacaagatcatccattgctctcacagaagaccctttttctttacctttctctgttttggcctctttcatgtgagctgcaatctcagtcgcgttctccttcatctcctttcccttcccttcttgctccataactatctctataaccttcttaacctgttccccagaaatgacagtttccacagttcgagtaagctcaacagccacacccatttcctccaccaacatctttacattgtatgcttgttctgcagctagtggccatccaattataggaaccccacagctgagactctccaacacagagttccatccacaatggcttagaaatgctcctgtggaactgtgtgacagaatctccaactggggtccccatttgtgcaccaaaaggccccgtttggtgtctctcattctctcttcaaacccttttggcaaccattctgcaatgaactctccattgatgtcaaaaccaaaaggtggccttgtgacccaaataaacgatctaccactctcttccaaaccttcagccaaagccatcatttgagatgcactgatagtgttttgtgacccaaatgaaatgtagagaacagaactctcatccttcgaatccagccactgcatgcatgcatcaagggctatgccagattcttttcctgcacgatgttttgaatccatgagtgaagcaggtggaaggagaggccccacagtccaaacgggaagttgaagatagttcccgagaaggtgcaaccccaaaggctcaatctcctcaaccgtgttgcaaatccacccatcagacttcatagaaagtgtaatctgtggaacaatgaatcttgaccagtcatcagtgccatcagctgctagaagaaacttatgcaatatagttcggttgaatttgtagttttgagggaaccccggaacgcaaaactcatcagagtcagttttcctgtgagggagattggaccagatagaaacataggccaaggttccataagcaccgcaagtggtgaagcttagtgatatgcgcccagcatatgaggattttccaagcttgtaaaccaagaattaagcatagagcattcattattaccttctgtatgcgtgttttgagttatcttgatgtattgacaggaaatcgaccaaaataccaagacaaaggccaaatcaaaggagaaagagccaagcctgaagaaacatctggcgccaccagcgccaggagtggcgccccgggcgccatggattctggaacctggcgccaagggcgccagtatcacgcctggagcgtcattaactctggaagatggcgccaaaagcgccacgttgacgccacgagcgccacatcctctgcaagtcggcgccagaagcgccagtatcacgcctgaagcgctgcaatcactggaatcccgcgccaagagcgccgataccgcgccacaggcgccgcattctctgtaatctcacgcctggagcgccagagtggcgccatgagcgccacaggtcgacagcagccacattaagggcaaaacggagatttcatgtagagggctttaaatactccaaccaccagcattcaatgcacgctttttgaaggagaaaaacacaaatttagggtttctagagcttgggtttttcttagctagggattaagggagttgaaggcacaagtggagttgcatctccatcttcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctttcattgtagttagggcactagcatttgatgtaaatttcagtgggatgtattgaatgctcttattcatttatcaaaagctattttactgcacttgctttaattctttcatctcttccctggacttggccattctttgtgagagtttggagctagggttcacaataggaatattggggctctggtttggaactaggtgtagtaacttgctaacattacctaggaatagggatgggtgcttgtagcttgtttatttatgcgcttacttcatgcttaacttactgaaaattgctaaggagttagaattggagtgtgagttaaagaactaagtacatgaggaatcaaggcttagtcaactttagaaaacgcattagctaaatagcttagataagtgaagatagtaaacaatacatttccattgagaggagcatcatgtgtgggttgccctagctacatctcttgcatattattacccctccaattacttgttgatattagtttccttgtttacacttaacctttaatttaattagtacacatacaacaacacacaacattattcttcattcttttggtatccaacttatcgatcagaattatagtctatttggtcaaacaatcctcgttgggaacgacaaatcccttcttatcactctattacttgtacgatcggtgcacttgccgattacgcaataagtttttggcgccgttgccggggattgttttagccaaattcattataagtttttatctttaagattggatttcttttgttactaacctgcttccagagtatatgcgaggtaccgttagccctgaccaactccaatttgatcccgaaatcgagaaaaccgcgaggaggaatcggaggttaacaaggttaagaagagaagcagaagggtctagttctcaacctctagaagaagaaatatctgaagaggaactggacatggctgaaaacaacaacgagcagccaaggccggaggatgaattgatggagaacattcttgctccattgtttgtccgtccggcgcccagcatagtcaggccaccaattcaagctcatcactttgacatccacccgtctcttattagcttggtggagaagaaccaatttggtggtgaggatgatgaggatcctcatgactttgctgaccactttatgatgatttgcgataccatccgccatcaaggagtgacagaagatgccattcgcctgcgcctttttccttttgcattgaaaggaaaagcactcaggtggttgcatcgtcagccctctaatagcatcactacttgggatgagttgatggcaagattcttcgctcagtatttttcaatggagaaatataaccgcttggtgaatgaaatcaccaacttcacacagctccatggagaaacactatgtgcggcttggactcgttttcaagagcttatccggcgttgccctcagtatgatatgtcagtggggaagaaagtgaggattttctttaatggattatcaccggaatccaagatgatagttaatggagcagctggaggctctatcagatcaaaaacagctacccagacacatgagttaattgattctctagctagaattgagaatgagagcatagcaagtcagccaaagagggaagtgattcatttgggtagcactgacgctatgctggctgagcaaaaactcctatcacaacagctagccatcctcaatactaagattgacaagctcgaggtctctaaagctcaagcttcatcaatcaaagcaggcatggctgtgtgtgagtattgccaaggggaccatgagtccaacgtttgtccaaccttggtgggggctgatccgattcaagtgaatggagtatggtatgaccaaaggccaccacaaggttatcagagaaattatggtcaagcttctgggagtggaagtaactatccacgaagaccacatgggggtggtttggattacaaatccaaccattatttgcaaccaccacccatccctcccaaggagccatctgagcttgaaaaagctatgttgcagctggccaagactacaaatgaccatatccagaacactgatgcttttatgaatgagacaaggtctcatttgaagaatcaaggtgcatccatcaggaatttggagactcaaattggccagatatcaaggcaactagctgagagaccaccgggccaattccctagcaatactgtggttaatcctagggaacacgccaaagctatcaccactaggagtggcattgttattgctcctaaggagaagacaaaggtggcaccaagaggagaagaaaaaggagtaccacaagctgatgcaagtgcagaaaattctgcagcacctcaaaattctgcagaaattgaaaattctgcaactccacaagattgcagcagctccaaagaacccgaaaaagataagggaaaggagaaagttacagcggagcctaaacagcctttggacttttccagatttgagaaacctccctaccctttgaagatgaagcaacagaatcagaaaaagcaatatgccaagttcttggagatgttcaaaaagttgcaggtcaacattccatttgctgaagccttggctaatatgccaaattatgccaagtttatgaaggacttactctccaagaagcacaaactgcaagaatgcgagaccgtggtcttaactgaagaatgcagtgcaatcattcaacagcgtgttccacctaaactcagggatccaggcagcttcaacatacctattgccataggtaatgttaatgttggcaaggccttgtgtgaccttggtgcaagcattaacttgatgcctctttcaatttgtaaatcattgggcatttccgagttaaagcccactcgggtttctttgcagctagcagacagatccttgagaagacctagtggatttattgaagacatattggtcaaggtggataagttcatctttcccgccgactttatagttttggatatggaagaaggggaggtacccgttcttctaggtaggccatttttggctacggccagggctatcattgatgtggcggacgggaaattggagttgaggatgttcgatgaatctatcatcttcaatgtaattgatgctatgaaggctccaattgacaagagtgattgctttagaattgatgtgctagatgtgttgatccaacccaataagcctcctgaacaagaacttgaagaactaatgcaagttcaggatgagactgtcttggaagagttagaagaggcagccatggaagtattagagaagaaggccacagacattgaagttggagcaccgaagccgaagttgaaagagcttccagcaaccctcaaatatgtgttccttggagaagataacacctatccagtcatcataaatagaagtttatctgaggatgaagaagctaagctcaccaaagtgttgaaggatcacaagtcagccattggctggaccatatcagacttgaagggtattaatccttcattctgtacccacaagatcttgatggaagacgatgtgaagccggtaaggcaaccccaaagaagacttaatccgatgatgaaggaggtagtgagaaaagaggtagtgaagcttcttgatgcgggcatgatctatccaatttctgataccgcttgggttagtccggtgcaaactgttcccaagaaaggtggggtcactgtgattcagaacgacaataatgatttgatccccacaaggactatcactggatggcggatgtgtgtagactaccgccgattgaatgaggctacaaggaaggaccattttccacttccattcatcgaccaaatgcttgagaggttggctggacatgaatattattgcttcctggatggatactccggctacaaccaaattccagtcgcacccgaagaccaagagaagacagcattcacttgcccttttggagtctttgcttacagaaggatgccattcggtctttgtaacgcacccgctacattccaaaggtgtatgctttctatcttctctgatatggtagaaaaatctcttgaggtgtttatggatgatttctcggtgtttggttctagttttgatgcttgtttgcttaatttggctaaagtcttaaagaggtgtcaagagaccaacctcgtgcttaactgggaaaagtgccattttatggtacgtgatggtattgtcttaggtcataaaatctcttccaaggggattgaggtggatgaagctaagctgttgctaattgaaaaattgcctccacctgccaatgtgaatggtgtccgtagtttcctaggtcatgctggattctataggcgctttattaaagatttctctaagatagctaagccacttagtcaattgctagtcaaggaatctgaattcaattttgatgctgattgcttgcatgcttttaatgtcttgaaagagagattgaccactgcacctgttttgactgcccctgattggagtttgccatttgaacttatgtgtgatgcgagtcaatatgctataggagctgtgttaggccaacgcaaggacaaattgttacatgtcatttactatgctagcaaggttttaaatgaagcacaagtaaattatgctaccactgaaaaagaaatgctagcagtagtttatgccttggacaaatttcgttcttacttaatagggtctaaagttattgtttacactgatcatgctgctcttaagtatttgttgactaagcaggatgccaagccccgcttgttgcgttggatgctcttatttcaggaatttgatttggaaatcaaggacaaggcgggtgtggaaaacagagtagctgatcatctctctagaatccaagagaaggacttgcaagatagtccacagctggagattaatgatgcatttcctgacgagcagatgatggcagcggaaagcactccttggtttgctgatatggccaactataaggctgtgggggccattccagacgacttgacttggcaacaaaggaagaaattcatgcatgatgcaaggagataccactgggacagccccttcctatacttccaatgtgctgatggtataatcaggagatgtgtggctgagtttgacgtgccaaaaattctctggcattgtcattcttccagctacggaggacactttggaggcaaccggactgctcataaggtgctacaaagtgggtattattggcccaccatcttcaaggatgccaagatatttgtggagacttgtgatagatgccaaaggacagggaacatttctaggaaggatgaaatgccacttaacagcatcttagaggttgaattgtttgatgtctggggcatagacttcatgggaccttttcctaaatctttctccaaccaatacattttggtggcggttgattatgtctccaaatgggtagaagcagtggctttgaccaccaatgatgccagagtggttgccaattttctgaggaagaacatcttcactcgctttggagttccaagagcaatcatcagtgatggaggcacacatttctgcaacaaatacattgagagcttgctcactaaatatggagtaactcataaagtggccacaccgtatcacccacaaaccagcggtcaagttgaagtgtctaatagagaattgaagagaattcttgagaagaccgttggaagttcaagaaaggattggtccaagaaattggatgatgctttgtgggcctaccggacagcctttaagacaccaattggcatgtcaccatatcagttagtgtatgggaaatcttgtcatcttccggtagaattggagcataaggctatgtgggccaccaaattcctcaattttgagctctccaaggctactgagaagagattgttgcagctgaatgaacttgatgaattccgacttgctgcctatgaaaatgcaaagctatataaggagaagaccaagaaatggcacgaccagcacatccattccaaagagtttgttccaggtcaacaggtattattgtacaactcgcgtttgcggttgtttccaggtaaactcaagtctagatggtctggtccctttatagtggtaaaggttttcccttatggcaccatagaaatttctcctcttgataaccacagaccttttaaggtcaatggatggcggctgaagccataccatggtggtcaatttgatggggaggcaagtgctatccctttacgctctccttaagccttaaaggattcaccgtcaggctcgtgacgttaaacaagcgcttgttgagaggcaactcaatgttgtgtaggcaattaattcttaggttagtttcaatctttagttcagcatctaacatagtagaattgtcaatcctttagtttttacttttgattttgttttgtttttcatgaatgcatgtgttaatcacttcattttgattttgagacactaattttggcatgcgtgggctatctcagccccaacaaatctgggcttgagaaaaaggatggcgccaaaagcgccacattggcgccacaggcgccgctatttctgaaattccgcgccccaggcgtggaactcgcgctccaggcgccatctactctggatatacacgcctcaggcctgcactcagcgccaagagcgcctcctggactttcaaaaggttatttggcgccgcaagcgccaccatggcgcccggagcgccaatgtttctgctagatcgcgctgttggcgcgaactatggcgcttctggcgccatttgggttggaattgattctgaggcgcttgaagcgccaatggggcgccccgggcgccttggtttctgttccaccgcgctcctagcgcggattatgacgccaaaagcgctggctgggtttctggtccaactaatggcgccatgatggcgctgccagcgccgttatcactggaactccgcgcttggagcgcgacaagggcgctgccagcgccgtgtcttctgcctgttcgcgcctctagcgcggtgatggcgccgcgggcgccgcacttagggcgctgtgtgagcttttaaaattcacaaattcccacacacgcgccctcctctctcattcgttctgcgccttccgagaccagaccaccgcttttcctctcaacctccattgctccttttctctctcccaccttcatcctcgtcctccctactccctcaagctttctttctctctctcttgcattcgcttccccctgctgcacttcaagctctctctctctaattcagtttgccatgggtcgtgataaggtacgcgttccttcactggttgctttgtgggttacacaccccatgggaaagggtcatagtgaacccccattgttgctgtctgttggttccattttccagttcgcgcccccagcgtgggtatccacgccatgggcgtggttggacttttatttgaaatatttgtgtttaagctgttgatgtgggtctatcctttaccttattgtgagaaactcagtgcttaattgattaatctcagggtgttagcatgttgtggggtaccatattggggcataattacattgtgctagggttttagagcttttatgtttattccattgttggcaagctactctggatttgtgaatgaaaccctaggacctgagaccaccaactgtatgattgggcaccattgttgcagttagctttaaccaacagaatgccttacactttgtacatgtgaccactaagctctaatcgaatctgaaattgaaaattctaatgctctctggtgatagtttcagtgattgtgagttgactttgaatgaaaaatggaacaacctttgttgagataattggtatgaattgaccccacacttgctcctgcacagtaaccacttccaacccaaaattgtgcagtactctgttaaacatgaaatctctgatatagccttaggcttgctgtgtaatttgtattaaccattgaatctgctctgatatgcattaactccttgttgtgttcatggctgtcattcatgtttttgctaagattcattccccaaggacatagcattgaacgaatctgggaattggggaattgtgtggctgacggagtaccattttgaaagatcagatgtttagaatgctaggatgtgctgtcacttaatgaacatgagcataaactctttaatttgagaagctgttggaattcttgtttgaattacctcaagcctatgatctgttaattgttcatggttctattgtttgatgattggcctgagatgtttataatcttctgcacttgcatgcttgttgtaaatatatgaatgggaaattccatgcaattatatgtgtgctgctcagaacatgattgccaatgacattgttgtaaataaatctgggaattgtggttttccaagtatacctgtttttaacaagctaagggaaaccatgtggtatctctggatcttctgacttgcagggcaaacaggttgataagggtaagcagaaggtcacatcagggcataccagcaaaagacctcgggcatcggactacgatgacagtcggttcctttccaaggaatgtcaagaccgctttgataagtggttcatgccgaagaagatcatctcggagagggtgatcgattgggaggatcttccagcggagtcccttattcgaggtgtgattgagacccgccagtggcagaagctagtgagctttgccgatatgagctccagctccattctgaaggagttctgcgctaacattgaccggacgacggtagagagcgagcgacgaagctgggtgcgtgggatagtcgtcccttttgaccgcgagttcatcgaagactttctcaggacatctgtggacgagttgcgccgctgtgggttcgccacacgctatgaccggatgcaaccgctcccttgcactggcaaggcgacatatcgggatgatatgcctgctctagctgatgagttgcgaagagggatcactggtcgattctccgcttggcggatgaagatcggatccgacttagtgcctgagaagctccgccgtagtgagcttaatccagagtcagacttctggcacctcttcgttaactctaccatcattccatccaccaatatgtcagatgtgaatgtagagcgcgcctgcctcctttatgtgctgcagagagatatcaacctcgatatctctcaagccttatcagatagcatcctgcacatgatcagggatggcagagctcactctcaccttgctcattcttccctcatcttacacctctgtatgcacgccggccttgagatcgcggatgaggagcctatggacgtgccccttcgacccactttgacgcatagatcttacttggacggtctccgccgcaccctccaggaccagctcctccgtggagctgatttgtcaccacaggagttcgctgctaggagtccacggcccttcggccttgagcaaaccgtacctggagatccaccagccccagccacatcaccacctcagccatccactgcagctccgccacctgtacctgagccatccactgcatcatctcaggcccctcacagagacacaccatgggtgagggtgcaacagcagattcagcaacaggctaccatcctacagagcctccagcatcagattgagcagcagacccagatatctcagaggatgcaggttcagcttgatgatcagtcacggctgctcagagcattatgcagtcactttggggtagaccccagcagatcaccctcccagccacctccattggcttttgcccttccgtcaccagaagcacagccttctcccattgctgccgcagatgccacagacactatggatgaggatcagacacactgatcttcctcgttctttctctctctttaaatttatgcattaacttcatgtcatttactttctgcctttacattcagtacacatgacatttctgccatgattgacattattttacgcgcgagctctttggttagctccttcactgattgattttcggttatgcatgagtttgtttcctctaataacgtgttgtctatgtgtcttatacgttaccttgttggggacaccaaggggattaaatctgggaataggggcacgttaatcgaggaaacaagtgtcgttttgtgaatcatgcgtctttttggttgagatttgaacagtaggcagaagctttttggacagatactttttgggataaaaattttctttttgtgaagctatacacagaaaattaactacaattcattttgcgtctaattttaacctaagcataggtgtacatattagacaattttgcttaaggcatgccctcccagattagaattgctaaatcagctgattgttgaattgattttggaaagcattggtgaggtgaatcatgaagtcatgttgtctgaacttgaactgaagcgcatgaatgtttgtatgaatgaattcaattcgaaatagaatgcatggtttgatctgatatcatcaggagtctagcttgtaccatagcctgaaaggtttgagcctaaacagttaatttcttttgagtaaggcctcattgtgataggatgctagaacttgattggtttctctctaatgtatgcatatgttgatgtgataaaggcattttgttctattaagcttgagccaaatagccttccttacaaagtaaatcccttgctaacccctttgagcctgaagccttctttgtttgaccacctgagaatacaccaaaccacaaccccaccatnacctgataatacaccaaaccacaaccctaccattttgagattgaactgctaagtgttctgtgggtttgttagaaaaaaaaatatatatatatatatataataagtatcaaggtgaattgatgaaagtaaaagagaatgaaaaacaagaatggcattcagttaagccaattataatggaaagggaaagaattaacaagtgagaaagaaaagaaggaagaagagaaagtggaaattcaaaagaaatgattggaaagaggaaaagaaaaagccaaaatgtagcaagttcaatcttaaatgctttttagtcactttccagatactcctacctctaagccaagccaagttacaacccagttaagaccttttgatcaactttgcatatattgtgttctttttgtagaacttgagaataagatcaagcttatggtaatcctagaacagtgatgcaatgagtgaataccttaaacaattgagtgtgagtgaattttgcatcggtgagggtattcaagttagacttcattgttgatggatgtgaaaactttgtgtgaagttttggctggatttattcatttgtagcatttttaagctaagagattgttcttttcaatattgattcttgagaattgatccatgcttccaacttgaactttgttgattgctgaggacagcaaaatctaaatctgggaattgtttgatatgcgcccagcatatgaggattttccaagcttgtaaaccaagaattaagcatagagcattcattattaccttctgtatgcgtgttttgagttatcttgatgtattgacaggaaatcgaccaaaataccaagacaaaggccaaatcaaaggagaaagagccaagcctgaagaaacatctggcgccaccagcgccaggagtggcgccccgggcgccatggattctggaacctggcgccaagggcgccagtatcacgcctggagcgtcattaactctggaagatggcgccaaaagcgccacgttgacgccacgagcgccacatcctctgcaagtcggcgccagaagcgccagtatcacgcctgaagcgctgcaatcactggaatcccgcgccaagagcgccgataccgcgccacaggcgccgcattctctgtaatctcacgcctggagcgccagagtggcgccatgagcgccacaggtcgacagcagccacattaagggcaaaacggagatttcatgtagagggctttaaatactccaaccaccagcattcaatgcacgctttttgaaggagaaaaacacaaatttagggtttctagagcttgggtttttcttagctagggattaagggagttgaaggcacaagtggagttgcatctccatcttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaaagacttcactacgttttctaagccatttgtgtattcagtggtcaccacatggccatcacgaagccatcttggtatgaaacaaaaatttgccgcttcacttacgaggcctttttgacataggttctgtctgtacatcaccctgtcaaatatgaggttttaggttaaactaaaataaattataacaagaaaatgaatatgtatgcaaagtgttctcaaattgtaattgtaatatacaagaaaagacactgaaataaacagagattttatcgggcattattacgggtgtgcttgattgtgttctcttttttttttttttttcaaaattnnnnnnnnnngctttcattgtagttagggcactagcatttgatgtaaatttcagtgggatgtattgaatgctcttattcatttatcaaaagctattttactgcacttgctttaattctttcatctcttccctggacttggccattctttgtgagagtttggagctagggttcacaataggaatattggggctctggtttggaactaggtgtagtaacttgctaacattacctaggaatagggatgggtgcttgtagcttgtttatttatgcgcttacttcatgcttaacttactgaaaattgctaaggagttagaattggagtgtgagttaaagaactaagtacatgaggaatcaaggcttagtcaactttagaaaacgcattagctaaatagcttagataagtgaagatagtaaacaatacatttccattgagaggagcatcatgtgtgggttgccctagctacatctcttgcatattattacccctccaattacttgttgatattagtttccttgtttacacttaacctttaatttaattagtacacatacaacaacacacaacattattcttcattcttttggtatccaacttatcgatcagaattatagtctatttggtcaaacaatcctcgttgggaacgacaaatcccttcttatcactctattacttgtacgatcggtgcacttgccgattacgcaatacttaggttcctaatacctaaactctttgcaacgttgttaacccagccaaggaacacgtcggatattgtgcaaagtggagggtgaccttcttcttctgtgatctgtgatatcaaggagcgaagtggaggctcaagggtgagtgatgcatgacatagtttcattagttgagtgagaggaagcttctctgtgttgtctatgttgggtggcaaaccgtgaagagtggagttgaagggtaactcagcaagaaggatttgatgattgggagaagttgaagaagaaagtgcagatcggaggtattgaatgttgaagggtgtgttggctatggtgatggtgaagcttgtgctttgttggatttgccttgctaatgccaggaatgggatgatgtggccttgggccatgaagggtaccatcaccacgtgccccttcttcttcttcttctttggtgtctccgtcatttgaacgagctcaaggaatggtatgtgctacaccctgcgctcagtgcactggctttggtacaagaaaatggttgttgtcttggttgctgtttcacaaaataaagcactgagaaaaagatgaatgaagaagtaacgtgacatgctacagagtcatagcctgttaggcttcaactttccctgtgccgggaccattcaacacctatttattttaaaattcaattaatacattttattttctttttcttcttgtcacgttatattatacttcatatttatatttttctctcttttttcatactgttagtgtaaaatgacatatggatgtacaattatatttttcctaaatcaaactagtttttcagtgtgtcacgacttgactaccttagaaggaaaaaaagggtaaatagtttatttagttactaaattatgcattcgtgcgaataatttagtctttgcatttttgaaataatcaatttagtttataaatattgtgaaaaattaatttaatcgagtcatgtatatcgcatactaatttgtcaataaataatataatgattactctaacattaagcatcatattttaaaaaccaaattatcattatgtaatatagtttcaatgtaatataatttcaaaatccactgttaaattaaaagtttctttcctgtatattatatttataaaattttatattaataaaaaattatttgaaaattcatatatatatatatgtatatatcaaaattgacatacaatatattttttaaaatatattaaaatataaattatatgatttcgtttttattgatgttcaatttcataaaatttagatattataaatcgtaggattaattggtattaatggtttcaatttgatgttaaccaagatagaaaaataatacagaatcgccttgttctagagaaaatctaaacatggccaatacatagacgaaatcacctatacttatagagcgagcaggccaaattcaaacttgttctaaaaagaaagaaggtacaaggaaacaaacaactcatgaaccatgaaacaaaacttagtcctctaagtaaaagggagaaccgaaaaagaagaatacaaagcatttggagatttcaaatttagtagaaaagtaagagccatacgaataggtcacccaatttcaaatacgcaatgtgagtcactatggtttaagcccaaaagaaacagaaccattttagcctaaattttttgacaatgcaaagcaaactcattaagtgtgggggcaactattcttgtcctcagggctaagggtttaggcctacatcaaaaaggaaagataacacgtgggtccaataccgataagacccaatatacctaacaaattatatcaagaaccttacgagcctaccaactccaattcaactatgaagtgcaatatctgataaaattaagttaaacaatgaacaacgaaaatcacaagattcactcctaaaacattccccacttctcatcacataagtatcactacctttaacgtattgggaaatattataaataagtcaaagagttaagcacttttgagagtttttctattgaaaatataatgtttttttattagaaaattttttaaaaatacttctaacattttatccaaacaaactctgacttgtgacttgagtatcaaaatccctataaatactttgtcgaagttcaactcatgcagaccgagaagagatttcgttcaaatacccccccttctaaaccaatgtcaaacaaaggcaatgtgaaagatgaaacatgattgtattgctttgagatgctggctagcgtagggcagcttcgcatgtttcacaccctgtgagacgtttatgtaccgtctgatatattatttacaaatccaatggttcgaagatatgatggttaaccaataggatgacttgctaattattaatttttaaataataatcagaatttttaatatctatatttaccttaacattgtcatcaactttgacaaataaattggcatcccataagtttattgcagcaaagtaggattttgtctttgatgacaatcaatttatccttcaacatgattatgcataaacaaagtatgaagaggtattagatcttgggatgagtttgtttaaactttaaaaaaataacttaaaaataagtatttttttaataatcatataagatttgtttcttaaaataaccaaaaaaactgttccagtatattaattgtcttgaaatttgatcttatgccaacaacaataatcattcaattcatatcacctgtatcaaatatcaatgtcattcaaccagcctccgtccctctttggtcagctgcgaacagaggttttacagaagagaattagcactcacaactcaacaaaccccttcatatattgaccactcttaaccggaataatggaacaaaaatagggactcaaagcatgcccatatacactcatcaatctcaataaacattaatatcattactagagttaaccaataacccagtcaatcgttagtcaattttctgttttatcaaattagtttgttacttggtcttctctaggttagcttccaatccttggatgtaacattatagatagattagataggcactaaaatcatattgccaacaagaagtgcagctttgtatttgaaatagagagaagggaaagtgataagacaataaattctgaaggtggaacaagaaaacaggaacattatggttataataattcagcacatttgaatatttgatgatataaaccaagtagtaggatgatataacaattcagcactcatgcaagtcgtgttagtcttttcacatataataagttgctaattaacgcttagaaagataaagagaaaaaagtataagtatgttgaaattgatggaatgtttataataaaaaggggttcatatattacttcttatatcataaacatctattttgatacattttccccctatcaaatcatattatttcacttcttatctctttctctctctttaggtgttatatatctaatagcatagaagtgtgtttataataataaggatattcgcatatccttactcaaatcaaactagcttttcggtgctgggggacctgactaccttggaaggaaaagaaaagttataaacgtccgccctatctatctatttggtttgaaggagagagaaataaggaaaataaaaggtaaaattaaaaaattatcttattaaattatatatatttgataaaattaactgatgaaataataaataatataaaataacagaaaaataataaaatcataatttatttaaaaatggtaattagaaaattagatagatatattgaagataaaaattgaaaaaaaaactaaaaattagtatttcaaaaaataataaaaattattaaaaattactaaaaaaattatttactgaataatcaaataaatttttgaactaataaaaaaattaaaaataaccttaaatgtcttgtggagccttagtcacacaaggttaaggttagcttgtttggctgttggctacataattttctctcttgatgagtacattatacgtctacccaacaatttcaacaagttcaatataatacctgtagcacattacttgtttttattacaatttaattcattgttataatcacttattcatacattactaagtaacagtacaactaattatttcccaaggtaatacatttcatagttgataaaagttctaattatattgctaaagctaattaaacatgcgtttgtaatcttggataaactcaaatccaaacatagactagattcccaaacatctaaaaattgatactctgcatattcttaatattgcaccgcacgtactacttttgatttcctgcaacttttttataaagcatttaagaaacatctcttaaaataaaaactcttaaaagcacattgaataatattctcattagagtaatcacatatatacatttatactttttaaacaaataattactatttataattattatttttcatatcacatcataatatttaagattattttctatgacaggatgtataataacatattcggtattccttttccttggcattacagtttcctatgttcgaaagacacttcccgttcacgaaaggcctaacatattcttcctaagcatgtcccacgacaccgaaaagctggtaagatattataaattataatatgcaatcatgcacagtgcagtgcatacgtggagtgcagtggttcacgtttttgccgaacactctctgctctgtccatatgtctacttcatcttatgctttaagttgaataaatactcgttttcggataaattgatccagctttctggatagaaaaaaaaattaaatttaattaaaatatataaaaaaaattgtaacagattcatttgattaatttatatggtccggcactttcagcttcaaggacaaaaaatacgtatttatcctttgtttatagtttatatcctttttatatcagaaaccaagtgaagggaatacgagtttataccttaagggttgagctagctccaatggcagcagagaagaaggggcacatcgtgatggtaccctttatggcacaaggccacatcatcccattcctggcactagcaagggaaatccaacagagaacaaaaagcttcaccatcaccatagccaacacacccctaaacattcaatacctccgatctgcactttcttctcctaatgaaatccatcttgctgagttacccttcaactctacccaacacggtttgccacccaacatagagaacaccgagaagctccctctcactcacatagccaaactctttctttcaacactcagccttgaagctcctcttcgctccttgatatcacagatcacagaacaagagggtcaccctccactttgcacaatatctgatgtgttccttggctgggttaacaacgttgcaaagagtttaggcattaggaacctaagcttcaccacttgtggtgcttatggaaccttggcctatgtttctatttggtccaacctccctcacagaaaaacagattctgatgagttccatgttccggggttccctcaaaactacaaattccaccgcacccaattgcataaatttctaagagcagctgatggcactgatgagtggtcacagttcttcattccacagactgcactttctatgaagtctgatgggtggatttgcaacacggttgaggagattgagcctctggggttgcaccttctcaggaactatcttcaacttcccgtttggactgtggggcctctcttgccacctgcttcacacagtggttcaaaacatcgtgcaggaaaggaacctggcatagcccttgaagcatgtatggagtggctggacttgaaagatgagaattctgttctctatatttcatttgggtctcagaacactatcagtgcatctcaaatgatggctttggctgaagggttggaagagagtggaagatcgtttatttgggtcataaggccaccttttggttttgatatcaatggagagttcattgcagaatggttgccaaaagggtttgaagagagaatgagaggcaccaaacgtggccttttggtgcacaaatggggaccccagtttgagattctttcacacacttccacaggagcttttctaagccattgtggatggaactctgtgttggagagtctcagctatggggttcctatgattggatggccactagctgcagaacaagcatacaatgtgaagatgttggtggaggaaatgggtgtggctgttgagctcactcgaactgtggaaactgtgatctctggggagcaggttaagaaggttatagagatagttatggagcaagaagggaagggaaaggagatgaaggagaaggcgaatgaaattgcaactcacttgagagaagccataacagagaaaggtaaagaaaaagggtcttctgttagagcaatggatgatcttgttagaaccattttatcacccaaggctttgtgatatgttgcatttagaatttggaatttggaatttgaatgatataataaagttgcttgtgtaagcatacttgtcatgaactgctcagcaatctttaacatttgactttgatcatgtcactgtgaagatcaaaagtacactttttttaattgatgatgatttgtaaacaaaaacaatatagaacgtcaatggatatgatctccataagttaactttttagtatataataatcataaattgatataactcatgaaaaccattaatatatgtgtataacgcaatctctgcagtctgcaagtgcacatatcgtcctactacttcgcttatatcatcaacaatactcaattatatcatcaacaatactcaattattcctgtttcgccacgtttagaattgttatcttaaagaaaattagtataaactgtattaaacgtgtttttcattgaaaaatgtaaaattttcattctattaatcaatcaaaactatttttttatcagtaatcaaaattatattaagtataatttttaaaataattataataaaagttactgtatattaaaaattataattgaataacaatgtaaaaattatttacacctccagtacatttaaattcattttgtattggaaaatagcatcattaattccagtttggtatttgaacttaaaattacccttcatatatcttccagaacatgccaaccgcatcgaaataatgactatcccgtttataatttaatttttttgaaaggctgtttacacttttacatccaatgttttttaatatatactaaaatgatttttttgtgaatagttactattcataaggtaattttgtcaccaagctaagatatgatttctaaaatttcactaaaaaatacctgcttttgtttgcctttttttctcccaaattcctaaacccatttctactcgttattcgttcggagaatgctcctccaccccggtgactggaaaggattttccaaacggttcctataaagtaaatctgttgcctatgatatgatacatgtacacaaatattttagacaacaaacttacaaaaaaaaaaaaaaaaaaaaannnnnnnnnnagctttcattgtagttagggcactagcatttgatgtaaatttcagtgggatgtattgaatgctcttattcatttatcaaaagctattttactgcacttgctttaattctttcatctcttccctggacttggccattctttgtgagagtttggagctagggttcacaataggaatattggggctctggtttggaactaggtgtagtaacttgctaacattacctaggaatagggatgggtgcttgtagcttgtttatttatgcgcttacttcatgcttaacttactgaaaattgctaaggagttagaattggagtgtgagttaaagaactaagtacatgaggaatcaaggcttagtcaactttagaaaacgcattagctaaatagcttagataagtgaagatagtaaacaatacatttccattgagnnnnnnnnnnttttttttttttttttcaaaattattttacaaagtaacatgcatgaaatatttttcagaagaaaataaaggcgaaaaaactatttgagaacacgaaaagaaaaattaacacattgattcgcctggtggcacttatttaggtaacagaaaacattgtataaaaagaaaaaggtaacaggaaacaacttacaggacccaagagttgctcacggatataggccattgatcgtagtacagcacccagtgtgtccttggtcacctgaaacttaacttcacttgcaccagaagtagtctccgcgactggaagctgaaacagtttaaagaatttcaacaatctaaaagtttgtcgaagtacatagccaaaaatcaaagaaaacattttcagaaggtgggatttccatacaataacaagtaacaaacatgcactcaatcccccatacagtaagaaataatacaattgatgacattctttttttggcttttgttctctttatctttccttttattctttatgggaagggggagacacaagccattgaggaaaaaaataacgaaaaaaacaaatgcacacttttttacatggacatatatatgacctatcaatgaacagatcttacatcatttccacaatgatttcaccctaatcaaataaaaatgccagatacatccacattgaacacaatcattactccacatatgtgctcctttcatcaaaaaatggcctccaatttatccctatgaatgaggctaagtatttatccctatgaatgttctttatattttaaactgaatttggttaggccaatttaaagatattaaagtaaaaaatcaagtataatgtcataccatgatattacaagttatctgcctcaacagcatcatgtcattttataaagctacattttcaaccgcatcatgtttgatacattcattaatagccaatatgaatgtgatcatacttgacaatttccccaataatcaatcttattgaccaataccaccatcctctgaaaaacaacagacagactagttctgttccctttcatttgttgccaatttaaataaaattaaaattctcttccttagtaatccaatcaataatatgtgctccttacacaaaaccttaccttataaatataaaaaaaaaaaaaaaactaagtaccccattgcccaaaggctcctcgctccttgcatatgcaaagagactgttttgggattcgaatccataaccaacaagtcaccaatgcacaactttaccgctgtgtcagggctcaccctcatttacagccattcagtaagaagagaagtgctttaaggaattttaatcatgaaagtgcaaagcaccatcaatccctgcttttctagtactagaatactaaggtaacaaagcatacggctgagaaagataaatctataaggaacaaaatcacacaccttgagattcaatacagcaaacttcctagttggtatggaaagctgatcactgatgttgaccatatggttaaacaatggttccaaggtaacttttgagagattaaacttaacctccgattctgttgaaggaatcctgctataatcttgcaactgcattcaaaatatgtttaaaggacttaggatcctcacatcgttgttatttgttaaaatattgcaagaggataaaagcaggacaccctgccacaattaaatgttacagaagatatttatacccaaaaagggacaaaggttgtttgagtctcaaacttctcatgcaaaagaataggtatataaaccaactctaaactaaatcatgactcatgagtactactacaaatttttcatcgttcatattattatcagcacaccttaagactgataacagctactctattccctggtgttgagttcttgttctccattacccacgtcaatgatttcagacacggataaaccacctacatgataaagcacaaggaagagtttaatgccatgcagtccaattccaatcctaagaatacatcaaataaaaagaagaaaagaggttctccttcacataccatttcaggtggaccatcatctcgctggagagacactggggtcatttgtggtaaatttagatcagcaactgattgaacaggagtactagcatcattaagattaaacctctgtgttgtttcgtcctgcaaaggccacaacagagggtttgtatctgctgttgaagtaggggattttctgtcatcataagcagtcccactgactggatgactgggaggggcaactttggcaacacttctcctcatgaaagaaatcttctttccactttctctaagagcactaattgcagtatcataagtttccacagtcaatgccccttcttcagcatatttgatggcttcccaacaaaggttactatatcgtgatgtcaaagactcgggtccatgtgattcatcagcaagttcaactgatccagcactgctttttgcatttcttgtccaccgttttaaaatgtaatgagatggtaatgtaagtacattagtcacagtaaaaacagttagaacatgtctacatagaatgcctgaatactcaaacatttggcaactacagttagctctcaactcagaaaggtttaatgtgacaacatacgccttttggtcatcctcaaattttgcaaccctgaatatgctattttctccatcttcttcaattctgttggcagtataagcaaaagtttccactaactcttcttgaaactttgaaaatattttccgcgtatagagattagcagcctgcttctccatcggggaaggtgtcttcagaacaggggaggtacaaattgtctcataatctgattctaattctttttcaaaccagcactccaatgcttgttcatactgcctaaagaacagtggtaatgttgtctggtggttgacaaaaccataaaaaaaagaaccatcaaatccttgattaggagatattgctgcaaaaaatgaatcacgaaaatatgctggaacccattgagcacgagcactgtacaaggactgaagccaatcatttttcgtgagttcatatttattgatgataaaattccaagatgaatcaaactcctcaatggtttcagtcagattaatacaattataaagttcaatctgaaaatttggatgcatgttgcatacatgagccaacttttcatggccttctcgcaagacttgccatttgcttatacaatggcgtgtttgaggaaaaacttgtgaaacagctgcctgtatggctctgtcttgatcggtagtgatagagacagggtaacattcgttcatcgctgtcagaaatgtcttaaaaagccacacaaaagaagcttcagaatcatccaaaagaagtgcacaaccaaacaaaatcatctgaccatgatgatttacaccagtgaatggagcaaatggcactccatattgatttattctgtatgttgtgtccagagtaactgcatcaccaaaatgactgtaagcagtccttgatcttgcatctgcccaaaacacattagacatatgattatcttcatcaagttgcattgcatagaagaaaccagggttctcagcttgcattttcttaaagtactccagcaggttgtgagcatccttccctaatgtcctctttcgagtaggaggcctaacagcataattcatcattgtaggacttttaaccggctgatttgtttcagcaacagcaacagcaacagctgcgggaatcttcttaattccatgaatatttttagtgggaatgcaattcttatccatagatacatacatcataccacttggaacaagccccactccttggtaagtttcaggcatggttcttccaacactagaaaagggcttacgtggccgaatattatgcactttactaatgctagccatggaatggctatgctcctttataaattttgtaacaacccacttattttgacccttcagctcgattctaatcattgcattgcagctttcaggaggctttcttttcgaatcttccctgccacacagaaactcccggtacatatttgccccatcagctgtggaacgaccatgcgggccagctttgcagctgaaacccactcgttttccatactcattgtagaaagtctttgcagcatcttcagaatcaaattccctacccacatatggctcagaaaccccaacccaaacatgagaaccagagttgttttcagcactactaactccaccttcactagattcagcatttccattgtctgccatagcttgacggtcacttccttctcccatgcttatcacttgtatgtagccagagttgcatgctttaatcctataaaatagaaagatgggttgtcttaaattgcctatacaccaagtaaacctcaaatattattaataatagaatgtagcaaaacaaagacaagaaccagtaaaaaagaaaaagaaaaaaaaagtgagcttcttcagattaaaagacaattgtcattaaccaaattaaggtgtgacacaaaaataaatctgtcccatcaaaactgagtcttatttaaagtgtacaataacgattcaaaactgacaggcatcatcagaaatttgacatagccaaaaacaatgctaacggaataaaagtttcatgtcaaataggtttaagctaaacaccataacagcatagctacaacacacaattttaatattcaattaattatcaccattgattatcacaaataggtcaaaacgcatacctagagatgaagtagccaatagaagttacaaaaatttaagtaaaattcacaaaagttaaaagaaaacaataaaaacagtaacggtaacaaaattcagtgtaaaaattaagcgaaaaattggaagtcataacttacagcgatgaaaactaagtgtggtgttaataaagctcgtgaaataattagagtgttccaaatcgggggttgaggaatcgcagaaacgcgtgaacggtgagggaatgagagagagttagggttccgcagctccgggcggttgcagagtcagaggaggaagaagcgtgagcgtgagagtgagtggatgtagtgttgcataggttagatatgagtacacacgtcatccttaccgtttgatctatatcaatcggttatgattcgcttagatcgaaatctattttaatgggaacttccttcgtttttctgtcttttgtggtgggatttctcacgtgcactgtgcaccatccatccatcgctgtgggatccacaatcgcatagcatatacaccgtacattttgcttatgattatattttattgtttcacaattttcactttccacttctctttttttttttaatatgtttttttacatgtctaattttctatttttaattatctttttattatttttgtaaaaaataccttattattattcaaaaaaattaaataaaaaactaatataaatttatatctaatatagttatattatattattacaatctctttcatcattaaattaaaattaaataagtaaaagactaatttagcctcgaaatgtcaatacaccattttaaatactcaatatatagatttaggataagactcttgactcaataaaagttagaataacttttaaaaatattcttttcaaaaaataataactcctaaaaatcctttgttgtattgtagcattaattgtttcatgaaggaaaatttaagtgggttaagtcatagttaacacttgctatttgaaactaatatgttattaagtagaaaaagttatgtcctaattatcatttataacttttggcctaataataaacgctcaattcaacaattaatatcataattaagatcacgagttcgattttcaacagaacaattattgagaaagaaattaattatttgtgaggttgtgacattaattatcatgaaagtccaagtgagtcaagttacaaaaacactcttattcaacaaaaacactttcatttttaataaaaaattctctcttaagaaatatttttaaaattatcctcataaaataataactcttttataaaacactcttattcaagaatgatgtttatatttattatataatgagacatttgtttcatgtcattttctttctatttctgaaaatagaaagtaaaaatatttattctttaattagaaggtcataaaaaagattgttggatatcttttatttcatgaaaagttatactatattcaagttttagtagattttaattattctcatgataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctaagatcaattaagtcaaagcaccttaataagacgtttatttcaaggtataatattacattagcagaattcatattcacaaaaatatcgtaattagaaatattagttttttggggtgagaaattagaaatattattcttccactaattaatatatatacgtaataaaagataacgttattttcgctctaccacctcaatcttattactcatcctataatctcacacatttccctattttatctaattttttttataaaaattgttaaaaaattattatataataatgatagtcattattattatttccattaaataaccattaaagaaacatgatgaaaagaaaaaatatatatgataaaataaaagtaatttatattcgtgtatctattctctgtttgatcctaattttctagtttgaccctcattttcttcctaaatctgtctttcctttttcaagatatcactgcttctattctctgttttactacctgtctctttcctcctcttcaaaattggataaggacattcataatttactctttcctaaattaaacagtgcatgtgatgaaagcaaagtttaaaaaaattgtcgtacgttcttaaaagaatgttacaagatactattcaggttcccatgatcgctctatatatgttggaagctattcctacttcccttagtgcatctttggatatcaaacaaaatcgattctaaatccaaaagtcatggtgaataattgaaattagagaagcaacaacaaagtgttgcattgctgtgacagtagaaaaataagcatgcatggtgtggtgatcgcaccatctacccaaagtgttgcttttgatcctggctgacacaagtggtgtgtctcttgtatgcacaggatctcgcctaagtgcttatagttagttaactctcttaataaaaataaaaattgtcctatgttcttaaaagaatgttacaaggtattactattaggtgaaatgatataactcaacatatggcaatggaatgaaattaaagtacccaagtcaagaatgacaaaaccaaaggatgagaagaaaagaagaagcagcttaaagagaaataacatgagtaaaggagagttctgtatgatcaacctcgttattcttttgcataatatatatagtggaccagattgttacccaaaagtccatgcgtatcatgaagagtccaatacatcttatagattacatccattaatctcaaaccagttgctttgataatcattgcttgaattttcattctgttatttgaattcaaaattaggatgagttgttatttttattctgttatttgaattcaaagttaggataagttgttatttccattatattatttgaatttaaaattagaattttgtaaatgaaggatcaattaatgagaaactgaatgatttgacaaattcttttctttctcctttccctactcctccttttgcccttacacataacacttttggaaagcctcaagagactcctgatttggcaaaatagccttggcgttaacgtcatgcatgctcctcgcaaacaaacacctgcatgactcactcgccgcgttaaagagctccacctccctgttattctaacctgggattctgcggtgtggcggtggcttcgtcgccggacattgtgtgtgtttgagagattgagagtaggtacgttttttcttttctctttctattttctcttacacagatatatgagtttttgtatatgcgtacgtaactgatggagccaaaataggatattatatttcgctgctgcaaatgctaatcataactgagtggtagtttttgttttatgtgagagaaaaaaatatattggaaaactctaaccaaagaataatacgagaggaaaaaaaagtccaataagatacataaaactgttataaaattggatcgtatatatgaatacaatatttctaaattattgcatatgcatatcaaaattctgtatcaaagatatttctgagctcatatatgcgttatgcgtgcagtagtgattggttattataattcattaatacccagagattagactgatgatcactaattctgagtaagagttggagtacaatattgtttactttaaatacaaaatcatgggcaaaaatttaaaaataatataatttaattaaataattagtaaaagggggcgatttgaacaatatttaggcatctggggtcaccaaacacgccctgcttaggcgtgtttaaacacgcccaagctaggcgtgtttaaacacgcccaagcaaggcgtgtttgggtcccttgtggcctataaataccccctcaaaaagttatttggtccttccgccttctctctagaattagctctgtcttctctctagattttgggtgttgatttgtctgaagcgaagccctgccgaattcgaagcgctgccgacaagtaagtcgatttaactgattgtgcctagtatttagtttgttatatttttaaattagaaaaatgttaggatcatatgaacttgttagcgacatatatattaggttagtgactagggttttaggtatgccagtgtagttttagggtttacgatgtgattagggtttagggtgtggcctagtgattaggggttagggttttaggtatgctagtgtagttttagggttcacgatgtgattagggtttaggttgtggccgattgattagggttacgtaattcggtgttggattagggcttacattgttattagggtttatggcctggggctatgtaggtttagggattaggacttaggctgtgattagggttgagggcctggggtagtgacgtatgtgtaaggttaatggattgtgggtacagataggttcgagggcttatattgtgagtaggttttagttgtttggtttcagacttaggggttatggatcccggtttagggttaatggcagtgaataacctagggtgcagggttacatacacatcactaatattttcatgtggctatagacttagggtttatgggtgtcggtttagggtgcagggcttatgttgcgattagggtttaggcgctgtggtacatatacttaactactattgagtaattagttttccaattcaagttttgcgttggcaaacagttccttttgaaatgacgaagggtttatgggtgtcgatttagggtgcatggcttacgttgtctgtttaggcacaattattggattataggatgagaaaacgcctgtgatgatgaggggtacaatcaacctgaggtctttagtgtttcaagctttgtgttggattacggtttagtctgagggcttaagttgtgattagggtgcagggcttatgtttttttacttagggtttatggatgtcggctcagctttcgggctgatgttgtgttcgtgtatttggtttaatgtatttgatgcatatgaaaattttgttcgaatgatttgttaatcgtcaatattttgtttaccgtgattttaaatttttgtgcatgaagatactaaatagatggctgattcatcctccacatcatcatcgcgatctgcatccgaccatgaggctgagcccatggatcccactgcctacgttgtccctaccccatacaagtggggtacgctgcgtaggcgtattcagcgcacgcacgtttcacaagttgtgtggaacggtggcgtgccacctcgggtattgaagactcgacgtggtaaggtgagcggtggaccagatgttgatgatatacccgaggttgttgctgacatgttgcgccatgctgggtttcttcatgtcgcacgcatgcgacatattcaggtatgcaacgatgcaactatgaaacgagttaagactggttaatttgataaattcagttgtttaatattttttatgtatttcagatggatgctccgctcattagtgctatggttgaacgatggaggccagagactcacaccttccatatgccacagggtgagatgaccatcacgttgcaagacgtggctggtattctgggattgcccaccgagggcaaggtggttaccggagtgacagttgacgagtgggcgaccgtcattgaggaggtgtttggtcaggaacctgacgaggagaacgagatgaaaggtggatatttgcgcctgtcgtactttgatagacattttgcgcattggggtgaggtggtccccgacattatccacgtgacgcggttcacgaaggcccacatcgcacgacttatcggatcatggctgctatgcgaccgatctggaggtagcatgattgcagcacgatacatgtcgttgcttgcaggggattttgtggacatcggtgaatatagctggggctcagccgtcctttcacatttgttcagacaaatgtgtgaatgtacagatccaggcaggagtgacatcggtgggtgtcatatgcttcttcaggtgtgggcgtggctgagattcccacctattgccccagctattccgctgcctacacagccggattggcattttggacatcggtatgtgtggttatatgttgttcttgtttgcaattgtcacaatgaagtgttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatcccacgcgctcccaggaagcttaagggtgtgcatgatctttcgctccgggggaaacgagaagacaactgggttcgtaaactcagaccatttatttcccgatgggaggttagggaccagcacattgagctcccccccttgattcaggggttgctgtcaccacaccatgagtacatggtttggttcagagaacacgggaagcggttcatcacgaagaagggcgcgaaggccggtcgtggtgtaagttttctttacatcctcatttgtctatttaaattaattatgctacatgacatgctagctaatatgtgtatacctttaaaattgtaggtcgatggggtggagtctttgtacttcgcgacgattagccccgataaggaggcctttgacttcgaatgggcgagtcaagagctcggtcggttaatgtctgtatttgccgagagctgtcgcgtggaggaagcaggcccatttgctcccgaatcccagcttcagcccgacctagagatttcagttgcagttacccgacgcagaaaagagggtcgtgggctagagcgtcggcggagaccggtgcagcaggttcctgagcccattgttcgaccgaggccacgcacggagggttactttaggcctcctgctattgcatcaacatatgggacacagcccgtatattacgaggctactgcacaggggggtcatgggggcatggactacgccgatttcagtaccgaagcccagatgcctacaccaggcccatcgctgacccatgccgcacatgttacgactgcaatgatatgtgcagatgtagatggcggggtccgtgttggaatgaacaccgagacccagtggagtgaggcagagttcgacgagatgctcttcaacatggattatagtcgagcctatgccccttggtaaacacattcaccacatcatccatatgatgcaggcccttcttatgcaggcccgtctcagccggacccttatcaggcaggcccttcttgtgcaggcccgtctcagccggacccttatcaggcaggcccttcttatgcaggcccttcgtatgcaggcccgtccgagccggacccttatcagccaggcccttctcaggcaggcccttcacagccagccccgtctgaggcaggcagttctcggcgaccacgaagacgggtacaacctgatcgacaggcacgtcatttgcagtggccaccgccctcagcttgatttactcgcagttactgttgtatttttttgtgttgtattgtaatggattgtatttcttaaactactggtgtttgtgacatttatgtttaccatgctcagtcgaaatattatttgatcacgataaccccgcaaaccctaacagtaacatacgccgtcaaaaccattaatgcataacagacacgattacaatgaataacagacacgattacaatgaataaggataattcgaaaacaacatttttagcgtacatgtgttattccatatcgttttctggtttgctaaaaatggctaaaatttcaatcggacaaaaacgtttccagtagttggattccgctagcatccttaacacgtcttcatcgctcagcaactctcttatgtcatactggattgtggtgtctgagtattgggcatgtgccggatgacggaaaaacatttttcttaccacctgtgatatgtgaattccattaggaggaaccccaacaggcgcaacttgcttgatgacggccttcagtgtatcaatgttgcatgcagaaggaatttcaaatcggattgggtttgttccagtaaaggcataacccacaaaaccgcctcttcgtgctatgttccaacttccgttgtaatataacattgcatcgtgtgtggggacgatggttgactgaagtaggttcattatgctgtcggctgttctgtttatggtgcataatatttctataggaccagcagtggacatttgttcgtgacaccttaacattctgcaaacatcatcatcgtttgttagtgcgatagaatggaaaaaatagtgctgacctgcgactagggatggttatcggtagtatatgttatccacgaaatggtcatcggttagtagaagggtgtgctgaatcgtactcttaagcgtctgaaacgaacactcgttaggaactcgcatggctatcggactggcaccctgaaaacaaacacccgtgtcgttgtgattcgtacatccatttggataaacgaatgctaatttggagttaccaatgttttggctgcttgtttctcctaagaatgccattgtatgcaaaatcaaatttacggggcgaggcatgttgtgtgccatggtgtagcttatatagctgtaatcgcgcctgagttgggcgtgcctagtcacgcccttgttaggcgtgttcaaagacgtggtcggtgggcgtgtctagtcacccctttgttaggcgtgttcaaagaggtggtcggtgggcgtgttgaatcacgcccttgttaggcgtgttcaaagacgtgatcggtgggcgtcttcaatcaaaccataatcacaacgtgcttcaaccgaggcaaaacttgaattggaaaactaattactcaatattggtgtttcatgtatatgtcattagtgaagtgtatgtacgacagcgcctaaaccctaatcgcatcataagccgtgcaccctaaaccatagttaatcacaaaatgcaaactcatgtccatcacaagcaaaacattatcatcatacatgttacacaacatgtcttataaatcaaatacatttaacaaagcattcataaaacacacataacaacaaaatcatgaaacaccaccaccctgagtaggacaggccgtacgagtatgtccaacttgcttgcacagaccgcatctacgagctctctgacccgtttcgacttcgtcatctcgttacggattctggtcgaccttggacgacccttcgcacgcaacatttccttgtcagggatgataactggatcttcactagggggaatagcaagttcatcgccaataggctgccaaggtaaagaataagcctcaaccaagttggatacgaggaacacatcatccacatattgcaaaggattccgacggatgtataaagcagcagctgcggcatggctacaagggtatttgaaggtcttaaacttcccagactgacaaaaacgttcagttaggttaactgaatatgacctgtcccagccatctgccacctcaaacgacgtttcctcaacgttatagctgcgtacatggtggcctgtagcaacgttctgattatgcctcatagcatcaaccagatttttacaatgtagttgtgattgctgcatctgtgcagtggccgtctgaccccttctcacaaagtattcaaccaatcgactgtatgtgtgcttcaccaaagcagtaataggcatgttcctagctcccttgaacaccttgttcactgattcagacaaatttgttgtcatatggccgtatcttctcccctcggcgtcatatgcacgactccacttttccttaggaatgctgtcaatccattctgcaacctcaggactggtattgcggaatcgttcatacgctatgtcaaattcggccatacagggagtataacctgcacaattataaaggcatgaacgttagctgggtaacacatttttaaacctgactaaattacaaataattttgaacatacccaaggtcatgaggctcttcttcaatcttgcactcttgaatcgttgattgaaattactggcaatatgacgaaggcagaaaacgtgatgcgcaaagggtggttgccaaccggcatgattctgcactgcagatataatgctccggtgccgatctgaaatgaggcatatattttgcatttgggttacgtggaagcgaatgttagcaaggaaatattcacaagcttcccacgtctccccctcaacaatggcaaatgctagtggcaggcattcattattcccatcctgagtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatcgttcatacgctatgtcaaattcggccatacagggagtataacctgcacaattataaaggcatgaacgttagctgggtaacacatttttaaacctgactaaattacaaataattttgaacatacccaaggtcatgaggctcttcttcaatcttgcactcttgaatcgttgattgaaattactggcaatatgacgaaggcagaaaacgtgatgcgcaaagggtggttgccaaccggcatgattctgcactgcagatataatgctccggtgccgatctgaaatgaggcatatattttgcatttgggttacgtggaagcgaatgttagcaaggaaatattcccaagcttccaacgtctccccctcgacaatggaaaatgccagtggcacgcattcattattcccgtcctgactcgtggcgatcagcaattttcctttgtacttgccatataagtgagtttcatcaatttgaatgacgggtttgcaaaatttaaaagcctcgcagcactgtctgaaagtccaaaacatgcgctgaaacacacgcttccctcggaccagtcgatttgccacaaaataatcattggtttgaatatcaaaaaaagaaccaggtgaaaaacgaagcatgtagttgcaccacctcggcaaaaatgcgtaagattcttcccaatctccataaatcattgccatggctctctgcttcgcataccatgccttacaatacaaaactttaaatccaaagctggtggtgatcctctcctgaaccaacgcaatggacacgcccggttcctccttaatcattcctgaaaatgacatagtgagatacagattaacaacaaaccttaacacaaattaacttctttctaataaagcaaaaattctcagttcataccgactacaagtgaagcaatgacatcaacatcaagttgtctatgatcctgtgatagacggtcgttgaggcaattgtgctttccaccccatctggaaaccacccacttctcaccgtacactggtttcatcaccctaaccctccaagggcaaccatccttgtgagcaacacacttcattgcaaacttgtcaggcttgctctcaaccacaaatgcttcttgatgctccctcattaggttccgcttaacagcaatttgtgcctcctttttcgatgggaattcctgttcaacatacaaatcgtcccctatttgccaaggaccctgcactgaacccgatcctgaagctgagccgccaaaagaagattcttcgcttgggtaattccaatcgatatatgtgtaatgtggaaccccgtcccaaaaaggaacaactgcaccgcctttaaatacaatacacaataataagcattggtttgcaaaatatatacatgaacaacagttatacgaaatcacctagggtttaagtcatgtaacttaccttcaactggttgttctgattgtgtcggtcgaacacccgcacggttccgcatttcagacggccccgcatcagtgtgttgctggaatgcatttgcatccaccccaacatcttcatcattatcggacgcactggtattctcctgaagaagacgatcttccatcgctatattttcatcatcatcatcttcttcatcgtcatccataacccaagttgggtcatgtgaatcttcctgagacatgtttgcaccaacagcatcatatgatgctacaccatcatatgatggtgcactcctgggcaaaacaactgacctcctgggcaaaacagcttcctcaactacagcgtaatccacatacaattctaaaaatttcttccgttcctgattaaaatattcttcaatgaccatttccaattcttcatcatcctgtattggacaccgcatgtattcatcttgctgccatattcttgccgtcagcaatgtgatacaagtgtttccgtccacacccaattttggatgtatcttctgatgcagatcactcaatgttgcatttcggttgattcgtgtcatcctttggtccccttcgaagacaacacctcttcccccttgaattttccttccattgaaaaaaagtttaacacgaacaacgtccgcatcacttgaactcatttcctgcaatcaacataaataaacgtcaaaaacacacaaacacccgaaaccgtcaattatgaaacacccgaaaccataccgctttaacacaaagtagacaacctaacacttctacatatgtagttactcccagtaaatcaccaaatggtgaaagaaagtcaatattgtcaaagacacaaagtcaatattgtcaacctagaccctaggtctagtcacgccaacccatacaccctaaccaccacatacgccttaaaccctaccacagatcccctaaaccctagttgtgttcccccgatcctaacccctcatcaccatataaaccataaacacttacgccggaaaccataaaccctagctatgtacaccaaaccctacaccctaatcaacacacacaccctaaacctttaagcggtaacacttaaaccctaggtgtgtaccccgatacctacaccctcagccagaacactaaaaccctactcaccccataaaccctaatcacagtatcaacactaaacgtaaaccttaaccaaaccctaaatccattagcctgacgtctataacagaagatcttaaccctaataagagccaacgacctacaccctaaactaacacccacaaaccctccctttgtacccgtagtcataaaccctaatccccatgtacacccaaaaccctaacacaataaatcctaatgacaatgtaaacccctaacctaaactgcaagccatcaaccatacgtttgtacctgtacacctaaaccctaatcacggcatatgccctaaaccctaaacctagataagtcccccaggccgtaaaccctattaacaatgttaaccctaatactaacctaaattatgtaaccctaaaccctagttatgttccccctatcctaacccctcatcaccatataaaccataaacacttaagctgaatccctaaaccctagctgtgacaccaaaccctacaccctaatcaacacacgcaccataaaccataaagcggtaacacttaaaccctaggtgtgtaccccggttcctacaccctcaggcaaaacacttaaaccctactcaccccataaaccctaatcacagtattaacactaaccctaaatcctaaaacgtcaacacaacacaccatgaatctaaaccctaaactaaactacaatacctaaaaccctagtcactaacctaatatatatgtcgctaacaagttcgtatgatccaaacaattttcttatttgataatacaacaaactaaatacaaagcacagtcagttaagtcgacttacttgtcagcaacgcttcgaattcgacagggcttcgcttcagatgatatcaagacccaaactttagagagaagacagagcgatttttagacagaaggtggaatggatcaaatgccatttgcaggggattttatagggatcagggcaccctaacacgcctagccagggcgtgtttaaacacgtctagcttgggcgtgtttaaacacgcctaggcagggcgtgtttggttgccccatatccctaaatattgttcaaatcgcccccttttgctaattatttaattaaattatattatttttaaatttttgcccaaaatcatgagatacacacagtgtgctcttaagatcatcatattaattgggaacattcaatgttcagttgttcattggtataaaaaaaataagtcaaagatacgaattaattaataaattgtattatttataataaatagatggataatcaaaaagatttaacccttgagcagtgtatatgagtttataaatctcttatgattgttttcgatacctacaaatgaccaaaaattaatatatgcacgatgaactggataatataaattataatttatacattgtaaataaaatttaaggattccaaaacgttttttaaaggacagcgtttttcaaaatatagttaactcatgcataaaaaagtgtatatatatatatatatagttaactttatgttatgatatctgatagaaaaaaagctttatgttatgatttatttagaatttttttatttaattattgctttagttcctaaattttgaatattttttttagtccctttaattttaaaatatatttttggtccttataatttgaaattttgcatattttagtcctaacttaataaatttacattttttgataatttttagttatgttaaattaatttttattttttaattgcttaaatttgtatttaaaaattatcataaaatactaaaaatttcatgtacttaaaattgaaagactaaaaaaagtatttttaaatttaaagactaagtaattaaatcttatttttttgtatttgtgccaaaactcaaaataaatcgaagtgctactaatactattagtgcaaaatgtttttgatagacattcaataaaaagttaccttggcgtcacattatattaataaataaaatgatcaataacagatgtatttataagaattaaatataatttgagttcctcacatttgaagtgttaacgaagaaatgtgtgcataatgttgacatgtgttcatttttgtaagttagaaatgaaaaaagtgttcttaaataaagaagtaagaaaaaacaatatagtaattttaatcatcattatattaagattttaaagtttttcttactaatttactattttaaaatactactaattcttcaaaatctaaaatgtcactatgaaaaccacaatgatattataaaataatttgttgataaattaattttttgatataatattaatttaatattgttttttagatgattaatttgataatatttgtttttttaaaaaaatatttttttcttgagttgtcctggaaaaggtagccagaaggtcgttggcatattcctttctcaacctgtggatctcaatctcgtactcattctttctttgtcgtcgcagacataaccacacaacacaaaccctaattgcatttacttaccccaatctctctgctcccgcttcgcttcatcactcttctcaaggtattttacgatctctctcccattcctttcccctctattttcctcctcttaattagacctttaggttttctttttttcccttttgatcacatcaaacttcaatcattcttatttttcactaattccattagtaattttaggattcctccacccttaatttggacatcgattgttgcttagcttagggttaacttcaggtttcccgattcgttatttttctcggcttcggtttgggaattttgaatttgttacgttctggggtttgagctttcaacccttttgattcatagagtaggatcctcattttttatggcatttgagtgcccgaatggtactgaggtttatcaaagtttagcacacttaatagcaaatccaggcataggcatagttgaatctaatctccagctttgtcccaaatccttcactgaaggaatagcaacctcaaaatttatgcctgctaccaaacctgaatctgggaagggtgtgaagttaaagggagcatccaagattaattccaaggaaggcatcaaagcccctgtcagtgctttgaactactcctcaattcctggtgatgtggttttcaattgtggtttgtccatcaccgaccttcctccggcattgatatctgagattctcaattgccttgatcccaaggatcttggtgttgtttcgtgtgtctccacaattttccaaagcgttgcgtccgagcaccatgcttggaagcaattctactgtgaaaggtgggggcttccggcagcttccttggctgtggattcaggtgtgtatgatgataagtcatggagggaacttttcgtggaaagggagtttaggagtaagacttttatgggacgttatagtattgatgtgttgtatggacatactgaagcagttcggactgttttcctattggcttctgcgaaggtcatatttacctctgggtatgactctgttgtgaggatgtgggacatggagaatgggttgtcaattgcatcatcacgaccccttggctgcactattcgtgccgttgcagcagatagaaaactattggttgctggcggtactgatggattcattcattgttggagggctgttgaagacctgcctcacttgtttgaacttagagccacacaaaaccggaatactgaggttcgactctggggacatgaaggtcctataacttcacttgctttagacttgacaaggatttacagtggttcatgggacacgactgttagagtgtgggaccgtcattcaatgaagtgtactgcagtgttgaggcacagtgattgggtctgggcacttgtccctcatgatactactgttgccagtacatcaggttcggatgtgtatgtttgggatactaatagtgggactttggtgaccattgttcataatgttaatgatggtaatacttatgctttggcacggagccatacaggggacttcctttttactggaggtgaagatggtgcaattcacatgtatgagattgttagggttggctatgagtctaaaacttggcatgttgctgcatgggttcctcactcggccgctgtgtattcccttgcctttgagtttccatggcttgtttccgcatcaagtgatggcaagctggctctaattgatgtgagaaagctgttgaggattagcaagcgagctctggggaagagagtttcaaagggaaagaatttgggtggagacacagtagagcctccacagaggatgttgcatggatttaagagcaatcttttctctgtggatataggagctgaacgaattgtctgtggaggtgaagaaggtgttgtcaggatctggaatttcacggaagctttggaaattgaacggagagcccgtgcattaagaggaatacgattagagaacagaatgaggcgacggaaactccagacagagctgagcaataaaagtggtcggagtgatcagtgttcagttgcagcgaagaagaattctgtcccttgtatttggcccaaatgtgggatgagcggaaagctgaaagcatagtgactgaggcagtctaatgtttgtttatatgcaccaattgacaatccttcatttttcttttcaaaattgatgtatacgatattttagtttcaagcaggtaaactgacctgaccactctctttacgtattatgatatgattagtttctgtaggtagtgatcagatcagactacaccactctacatttcaattggtacgattctgaaactgatagtgtttctttccaagaattgtttttacaattttacaggtggtgtttctacaagaattctatatgatgtgcatttgataacgcagtattgacattcgaccatcgatttaaacagattcaggatgctattgtcttgatagaatgcaggagtgggctcaatgattcttgcttctgagttctatgaaactaatagacgaaagcatttgcacgacaggctatggtagtaatacgggaagctcccctggtgatagatagtcatttatgtttgatgacgagcttattctttagatatgctcattacactccgaatcaatttgttcagtctaatattttcgaagttaaactatttatttgttctatatagttgtctttcattttaagtttactctttacactagaagactataagttttatgtatgttaagtcttggttcctattgccaacacaagataaaattttgtgactgtaaaatttctacaaaacttgcaacattttgtatatggattaaaatttaaaatagaaaccactataaatatcaattgaatagtataacatgtttttaatctcgtggatgtgtgtaacaaaccaccaatcattttatgaaagaaatcgaaggacgaaagaagcaactggctccagttttttgttttgcagagtagtgtctatataataggcgtatcatatttaccaaaatgtcaccaggttacacactagttttgagagtgcttatgcactcttcatgaaagaagtgctataaccccaattctataaactataagctggtgtttatcaataacagaaatcattaaagtttattaccctaagtcagattagattcgaattatttgtatttgaaaatattatagatgatgttttgtaaagaaaattaataaatactatatttaaacaaactcgactgtgtacagttagaaagacgatcagtttacgaggatttcttttaggaaatttttataagtctttgacgaggtcaagacttaaatttgaaataggaaaatgataagataaatgagaaaggtaattacaaaaaagtagtagaaattaatttgataatagatttaattagaactaatttaggaataaaatcattctagaactgaaatagtgactaatttttttaagagattgatttgataacttatgttttttcttaaaaactaatacaatctattatataatatgagagaatgtcacatgacatttccatattcatttcctccaaaataataaatttaataataaatacaattgatatcatttttattatttattcatcaatagtagttatcttttaaatagttaccttaattataatatatttctttcaggcaaattaaaaaaatattttgcaattaaaatttttgcacttactatttaattttaattttttttatataagttttattttatatatattttagttcgacactagtatgacaaattatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaatttaatttaaaatagaattaatcataataaaactaaaaacaaaatttatgtggaaaatgacttaatatatttttggaaataattcaatttcaaaggaaagatatcataatgcaaatatatatgaaattaaattttaaaataatttaatttaaaatcaatcaaactatgaagtatcaattcaaatagttaacattaatatattttattttttctttcccttccaatcaaaatgaaatggcattttttaataacatttttaataatgtaaaaacatttttttgatgatgtttgaaacttaaaaagataaattaaatataaaagaattctattgtaattaaaaaatttcactcaatttttattatccgaaatcaagcatgtaaatcattaaaaaaattaaatcattttaaaaaaaaagataaaaagaagacatgtaagatatcattatagtaaccaaagatttaatctaaaataatgctccaaataataacattttttgaaacatgtatgtatataaaaatatatttaaatatttcttaaaatttttactaacatatatatatatttattaaaatttaaactaaaaaaattaataatatattaaatcttggttgttgtggtgaaagaacaggttaagtttctactccccaacacacacgaaggaacaaacgcttaaagaaaaaacgcgggacacaacatccacgaacgacaatttacgcggttagactttcaattgttatcattattcatgatttaatgagccacaataattgggtcttctttttttccttttccctaatttcattcttttttatttgatttaacaaatttatttttgtttttattttttattttgttaaaattgtttaataataaaataatatttttttaatccatgtcatgggtgtttgatggggatcacccactggagagtgatttgcttaacattgtacttaaccaaaaacactataaatgaagtaaaaaatataaactataattaattttaacattgttacaataatcaattagtatcaaaattataaatatttaaactttttaatggttggcaatataaaaaaattatctaaataacagaaaattattttgataatgatttagaaatatattattatgttaatagcaattgagtaaaattaaacattcattaaatattaaaaaaagtgaatatatttcttaattgaataaaaataaaataatagatataataaatgatttgataaaaagagaaaaaacaaataaaggtaaaaataatgagataaaggaaaaattatgtgcgcctttataaaggtagacatgatatgatatgaaacacaggcaaaggaagaaaaagcaaagaaagagttgaagcgtaggctataaatagaagtttgtgaattgaattggttctatccaaaaatcctgtctagttttgttgttgagttgaaaggatgaatatgaataacaatgttcggtgggttctactcccatactttctcttccttcttcttcttctttttcttccttcttcttcttcttcttcctctttctgcaaccaccacgacacctctgccttgctacaactcaaatacgcactcaacacaccttccaaaacagaatcttggaacaacggcacagattgttgtgagtgggatggggtcacgtgcgacatcatctcaggccacgtgattggtcttgaccttagcagcagtaatcttgaaggtcaactccatcccaacagcaccatcttcagcctaagacaccttcaacgactcaacctagccggcaatcatttttctggctcttcaatatattctggaattggtgatctcgtgaatctcatgcatctaaatttgtcatactctggattcactggtcacatttcctccacaatttctcacttgtccaaattagtgtcacttgatctcggtagcttccacttgataaataatggtcccaactacccgagaatgagaattgatccatacacttggaagaaactcattcaaaatgcaaccaatttaagagagcttaatttagatggcgtggacatgtcttgtatcggagagagctctttgtcattgctaaccaatctctcttcctctttgatctcccttagtctccaagacaccaaattgcaagggaatctgtccagtgacatcctctgtttacccaatcttcaaaaactatatataaaacaaactgaaaatgaaaagctgagaggtgaacttccaaagtcaaactggagtgctccactaaggcacttggatctcacttatattgctttctcgggaaacattccctattccattgcccatttgaagtctcttaacaaactacgtctgtttggttgcaattttgatggaatgcttccctcagcagtgtttaatctaactcaactctcctttttagatttaagctggaataaattagagggaccaattccaagcgaaatcaataaactttcaaaattgcagtttctatatttgtctaataacaagttaaatggaacaattccacgttggtgttattctttgccttccttgttagagttggaacttagcgacaaccacctcacggggtcaattggtgaattctcatcttattctttggaatacttgtcactctctaataacaaactgccaggtaattttccaaattcaatatttgaactccaaaatctttctattttgagtttgtcatcaactgacggtcatctggactttcatcaattttcaaagttaaaaaatcttcttatcctcgatctttctcacagtagttttctctctattaactttgatggtaccgctgactacatcttacccaaccttcaattattatatttatcttcctgtaatattaatactttccctaaattcttagcaccacttcaagatctgacaacactagatctttctcataacaacattcgtggaagcattcccccgtggtttcaagagaagctcttgcactcctggaagtgcattagtcatattgacctcagtttcaacaagttgcaaggagatctcccaattccacccaatggcgttgaatactttttagtctcaaataatgagctgaccgggaacattccttcagcaatgtgcaacacaagctccctcggtgtactcaacttgggtcataacaacttgacaggccccattccgcaatgtctgggaacatttccttctcttttggcattggatttgcaaaagaacaacctctacggcagcattcctggaaacttttctaagggaaatgcattggagactataaagttgaatggcaaccaattggatggaccattaccacggtctttggcccactgcacaaatctggaagttttggacctggcagacaataacatagaggatacatttccccattggctagaaagcctccagcagttacaggtactcagtttgcgatcaaataagtttcatggtgtcatcacttgtttcggtgccaagcatccatttcccaggctgagaatttttgatgtctcaaataacaattttagtgggccattgccagcatcatacatcaagaactttcaaggcatggtgagtgtgcatgacaaccaaactggtttgacatatatgggtaacaacgctttatataatgattcagtagtggttgtaatgaaaggtcaatacatggagctcgagaggatattaattattttcacaaccattgatttatcaaataatatgtttgaaggagaacttccgaaggtcattggagaattgcattctctcaaggggcttaacctgtcgcacaatgcaatcactggtaccattccacggtcctttggttatttaagaaatttggaatggttggacctctcatggaaccagttaacaggagagattcctgtggcttttaccaatttgaattttctggctgtggtgaagctttcacaaaaccactttgagggaatcatccctacaggtggacaatttaacacatttgacaatgattcctatgctggaaatccaatgctatgtggattccctttgtcaaaatcctgcaataaggatgaagattggccaccgcattcaacatttcaccatgaagaatcaggatttggctggaaagctgtagcagcgggatatgcatgtggcttgctatttggaatgcttttgggatataatgttttcatgactgggaaaccacaatggctcacgagacttgttgaaggtgtgcttaattaattaagagtgaaaagaacaaataacagaatccatgcaaattgacaaggaatgcattagtttaatatggttctgtattatatgtgtttatcaatatgtatgtcttttgtttttgtaatttttatcttctttgtttgtgtaatgaaattcatctctcaatattatcaagtgatctatttcaagttgttgtgcaaataagtaaatttagagatcaatcaattttgttttaagttcaatttatttgccataaattgtctaattagtcgtatcctgcaaagggattgaggacaattctcgcgtccaaccttaaatcatcacaaaatcagatttttactaggaacaaacttggacatttttattaattaggaacaaacttggacagttttcttgaagaacttatattttcgcaattgaacatacaagagaatcagtgtatattagattttccatacaagctagatttgtgttttattgtttactagaagccatactaattacggcagtggagataaaatgaaagaggaattcaacaacatgctacactttctaatcatactattttaaccgaagttggttaagatgtttttggttgacattaactaaattttttgataaactttgatcgagactatttttgctagcgtcaataactcaagtcgacagtaacaaaaagatagccttgatctacgttcctccaaaatagctttagttgatgtgacaaaaaaatattatcgattgacattgaccggaaaatatcctagttgacgtcagtcaaaaatagtcattgtcgatatagacaaaaatcatgatcggtcaatggcaggcaaaaaaacataattaactgatgttgactgaaaaacctaaccaacgttaaccaaaaaattgtccagttgttgtcgattaaaaaaaaccctagccaaagtcagctgaaaaatagtcacaaccgacgtcgactgaaaaaatcctaacctatgtcaacaaaaaataaccttacctcgacagaaaaaattactgaccgacattgactgaaataacctagccaacctttaccaaaaaatagttccacattgataaaaaatagtctattgacgtcagccaaaaaaccctagcagaaattgacaaaaaaacatttgtgattgaagccgactaaaaacaaccctagccaaagtaggttgagaactgacttatgatttaaaactagataattttgaactataaactaatttcaaaaccattttaaattgatttttaaaaaattcaaataaattttatccacttaagtggaaatgaattttaaattcgatccatttaattggatttggattgaatatttcaaaatccaacccataaacatccctaaatgtcttgatatcaaatttacaccacctaaaactctcaaatatacaagtttaataaacaaaagtttcagaacattttggggtagcaaataattgtaaagccatatgctaggcccatgcagtacaaacagaggtaatgaaatagggtgctactgcactgaaacactgttgggtatgctttggaaatcattcctttattagaatcacacagcacaaaatggttttggtgctgacaacatttgtctttgtcctctgaaattgacattaaattatgcatttacaatattaaataagaactttaaaaaatacccaatatacaactttactaaagaaaatgtaatgaatatattattactaaaacacatggaaggaacaaagtagaaaacccataaatcacagatattgatccaaactcctaactctctccatggctgcgaaaattaaaactagtttttgtttagctacattctccattccaacctcaaaaccctacttaaactcgttcaccgtctcagcctccaaatccatctctggccgaaagctccgggcgacactgattgatggtgacctcgctggatccgtcgtgaagccgtgcggcggcgccatccctctctgcatgctcgaagagtttgacattcctcaccacctcatcgaccgccgcgtggcgttcatgcacatcttttccccttccaacatcatcgtcgacttcggtaaaaccccacaagttcatcaccctgctccgctgcgaggtcctcgactccttcctccgctcccgcgcacatgctgctgagggttttctacatagtaacgcgtccaggaaggctctggtggaactatgtggggataaatacgttcaacacatgacgtttgagagctatttgtataagaagttggcacgtgggagagtgttggattatgttaagcttttcgtcaataccgttgggagcttggtgaggtctaaagtgttggaaacacctcgcatgtagagtttgatactatgacttcggaaatcccactaagtgcatgtagcttctgcgtcatttttacgtggttttgctgcttgaacgttgatccaaaacgtgtttctaaacatgttctaaattgtttgtgtaatttctgtgtactgtattattatgtaaccttctaacggaggcacttttgaatttgatggaatggtggattgatcaccaattcaccaacacttctttaagaattgttttattcaaatacaaaagaacagtatacaaaatttcatttgttgatgtcataattcaagggcttcagtaaagcaacaataaacttatacaagaatgagcttatctgtccgtctaatcacacatcgaagacactgtccttcaaccgataaatcaaaggctttgttgatatccttgaactccacctcatgtgtgacaaacccatccaaattcagttcctgttgataattgcagatgaaatttagtaccaaacaaatgcatcctgaaaactttgttttatggcattattattttacttagtcatcactatgttaatagaagggatcaagagcatagctagactggaaaaaattaaaagaaattgcacaaagtaccttgtccaggtagcgtttaaggagaataggtacgtcagacttgggtttgagtcctccaaataggcaccccacgaggctcttcccactatggaggacctcattacaactaaggctcaacgtgggtcctggcttgtccactcctaaaactattgtttttccccaaccctgtagggaaagcatcagttttaacaacattcaacaagtttgcatctgataagagtttattattaaaatttccaatcaaacctgtctcaatttgacaggaaacttcattttcatcaagtaccatgaatttcaaattagttagcacaaaagaaaacctattactagtgctacttttagtgctaggttgatcctttaaaattattctgcagttattcattcaatcacattactctgtcggtctataaaccatcttgcaaggcatgtttaagggcactttgagagatatatagatagatagacaaatagatagatagagggagagggatagagagagagagagagagagagaggagagagacctttttgcaagaagcatatgcttcttgcaccaatgatgccattccaacacattcaaagcaataatcagctcccccgccagtcatctctatgataacctgctaaacaagcacatatgagaatgaaatttcaagacttaaggcaactaaattaaataaatattggagcctagaagagggtagacctggctcacagatttgtttttactttgtccagcatggacaaagtcagtgagtccaaacttttttcctgagtaaatcagaagaacaaacccacaaaatcaattatataatttgagcacaataatgacacaaaacaaatttgtataagcattatcattaagcagataatgcattaccagtttcatatttttctgggttgaaatccacacctataatcctagttgctccacaaagtctagctccctcggcaacctaggaaaccagtcacttgctatgagcgtttgagtataataaaccacaaaacacacacaaaaaaagctatgtggattccttactgctaatccaatacttcccaacccaaaaatggctactgtagacccttggctccacacctgctgttctccaagcagcacctacccctaaaagtgcaagtttaatcaaaatactgaattagatgaacgttgttgagtagtgaattaaaaggtgaatacaaccgtgtgtttatttatgataagatattctgactataatttttattatgcaactgatatagttcttcaatattctttttgtttaatgtttacaattttgcatggtttaggcaaattacatgttgatacaccacaactaagtaggcctgccctgttgggtggtattgctggatcaatcttggttagatgagcaatgtcaaccacggtatactcactaaaactagacgcaaacaagaaatggggtatgatatctccttttaaatccgtgaatctagaggtggcatgtctaggcatccaaggagacacctcgaaaggaaactttgaacaaaggttgctcttgcttgatttgcaatctatacaatccccacaatcaggtaagaaaattggaacaaccacatatccttttgtgacttcggttacatcctctcctacgctttccacaaccctggatcatatcaaaattagctagaacatcatcatcagcttctataatataatatgcagaagatataatggggctcaaggtggcaaatcgttggcaaccaacacaaaaataggtagcaaagataaatataattagtcgtagaatttgttcttaaatcaatgtatcgattactgttgttaaatcatctgaaggtttgcagacacactttgctttgttatttaatccttgatcaaaattgaaacattaaaatttgcctcataactatccaatcttttctctaggattgaatttagaaaatcaactactcctgatagttagaccacaaagaggcctctaaacaattttagcatgtgtaacacagaataccttttttttttattattttgaaaggaaaaagtaatgtattgaataaaagaacaaaggtttgagcacaaactggtcaaaaccaagccattacatgaataaaagatatagcaatagagcccaaaaagacaagccccctaacttaatacaactgatgtatgtagaaaccacatctgtaaggactagggagtaagaaccacataaagtttgaccaaacatttatatattaaaccacaaaagtttactctacctacctaaaaagtaaagcgcaaaagtttatgttgatacagaaagatacaatacaaatagggtattaataaacagtggatttctttttccttaggattgaataatattatccagtaaataaaattataaaactaaaaagagtgaaaggcatacactcactcacccaacagcctcatcccaagattcttgtacaaattgcaggagggacctttaatatagaaaccactataaatatcaagtgaatagtataacatgtttttaatctcgtggatgtgtgtaacaaaccaccaatcattttatgaaagaaatcgaaggacgaaataagaaattggcttcagttttttgttttgcacagagtagtgtttatatatgataggcgtatcatatttaccaaaatgtcaccaggttacacactagttttgagagtgcttatgcactcttcatgaaagaagtgctggtgtttatcaataagagaaatcattaaagcttattaccctaagtcagattagattcgaattattagtatttgaaaatattatagatgatgttgtgtaaagaaaattaataaatactatataaaaatctgcagccatcaaatacaaactcgactgtgtgcagttagaaagacgaacagtttacgaggggatattgaccatgtaactggaggcttctttacaaaggagttcaaaacgactcttcttatttttcattttttttaaagtactatgggtgattcttttttgtttgtttttacctccgtaaatgaaaaataagtacgaaaacataaattttgcttatgaaggttgttgagaaacggggaaggtgtgacaggtttttcgaaaagaaaaaaggaaaaaaaaagttagacaattagtccaatgacaacacaacaggttatgaaagaagttgttttccttcctctatgatcaaatgggaaatacataaaaagttgtgtgtaattattgttacaccagaaacaccgatcaatattacatagtaacttacatttttaaactgagattatcaaatgcaaatctttggcttcttaccactttggatcaaacaagttctttatccctacttaaatggtttagctgtacaccaacgttatagcatcaaatcagttcggtcaaagcaattcgagtggacaaaacaaaaggaaaaagtaggcaaactatatggaggtttattgtttgttcattctgctcctgcagttctgctaatggtcattctctgcatagttcatggacagtcgacagacacactaattaccaatgctaatgtgacgaatagctcacatgtatcagcattgcatgtgttagggaattcctcggttgattgtggagacaacactctgttctaccctctgcttcatggtcgtctctctttgtatccatgtaacggctccgatgccacccttcttcctcaactacttggtacttttctttatgtttttcttcatcatttggactctgcattcgtgattcaagaaaattggacggaaccactgaaatctcacatgcaggatgcaggaagttataatttggaaccattgcatttgtgtcaggataaaataaatcttctttcagtgattcttataagtcctatcatggtgaatgaaagcatatttcctttcatttttttctgcataatgtgatctgaattaatgtattgcgatagctgcccatttatttgagcaaattattccataatcatgatctatagtgtcgtttaagtgacatcaggcacacacatgcatcatctctttctgtaagttcttcactggtaaattagaggggtaccaaaattatctgttatttctgcagaaacttttcaatattgacttacgatgagcataactaatgttagcacaggctcacacagatttaacactaattgatgtagtgggatcattgtgttgcagctgagaagattggattgacatcaatccggccattttatggacaaaatggatctctggaggaggttcttggtggcctcaactttggttcaacacaagctacaatcatgaaccagggaagctacagccaccagtctcttaaccaacaactacgccaagtttctgagactatgcagctgttgcaactgcagctgaatgaggacactgctctccaatttacaaaatcctccatcttttttctctccttcggcaaagaagattacattgagctattccttcataactcttccagttcgagtcgaatgttccagaacagttcccaatattttgctaccattttggtcaaccaaatggcaaatgctgcgaggtatctttataatgcaaatgccaggaatatcatatgtttgggaattctgccttttgggatgcacacctcgttgcctgggagttacacatcagctggagattataatgcaagtgtatctgtcgaacatgtcaatgacttggtctttgaatacaatagattgctggatgaacaaataggcaagcttaatacggaattttctgatgctcagatggtgttctgtgatgtttacaatggaatgatgaagattatcaacgaaccaagggtttatggtatgtttttcctcccttgataacttcaaattgaaaatttacctatgctgaatgttgattgtcatcaagcatttgaaatctctttggcctggcagaatctacaacaccaatctgttcctttatattgtaagaaatttacaagcactcatgtgaaacaactatatcaagtgttctttatactggttttgaagacatgaagagtgcatgttgcagacttggtttgaatggtgccatgatagggtgtgtctccatgtacatggcctgtgatcaagcttcaactcatgtttggtgggatttgttcaaccctactcaagcagtcaacaaaatcctagctgatgcagcctggtctggccaaccgatacctgatctttgccgtcctatcaccatccatgagttggttaacatggaagtctagcatttcctgtggctaccttcaatccttcatgatatcaaatttactctactcaaaattctcaaatatacaagtttcataaacaaaagtttcagaacaatttggggtaagcaaataattgaaaagccatatgtcagtcccatgcagtacagaaagaggtaaagaaatagggtgctactgcactgtatcactgctaggtatgctttgaaaatcatttcttcattaaaatcgcacagcacaaaatgggttttggacttttggtgctgacagcatttgcttttgtcctctgaaatcgattaaaactatgcatttacaatattaaataagaacttgaaaaagataccaaatgtacaactttactgaagaaaatgtaagatgttattactaaaacacatggagggaacaaagtagcaaaccctaaatcacagatattgatccaaaatcctaactcactctccatggctgcgaaaattcaaaataaattttgtttacctacattctccatcccaacctcaaaacccaaaaaaccctacttaaactcgttcaccgtctcagcctccaaatccatctccgaccgaaagctccgggcggcagtgatcggcggtgtccccgccggatcctcctcggctgagaccctagcatctggcgatctcgagaccttcctcttcgaacgcaaccgccgtccgtcgcgaagcggtgcggcggcgccatccctctctgcatgctcgaagagttcgacatccctcaccacatcatcgaccgccacgtgacgcacatgcacatcttctccccttccaacatcgccgtcgacttcggcaaaaccctaaaaccccacgagttcatcgccatgctccgccgcgaggtcctcaactccttcctccgctcccgcgcgcacgtcgctaccgaggtctccggcctcgtcaccggcctcgatctccccgcagccccggacggccctacaccgtccactacaccaccaacggatcctcgcgccactccctatccgtcgacgtcgtgatcggcaccgctccaatagcggcgtggccaaagccgtcggcaccggcgactatgctgcgcaatcgcgttccaagagtctttttatatttttatgccttttaaatacaaatatttaaaactaattaattgtaattaagatttgatttaacttttgattttaaatcataaactatataaaacaaagattttttttatatataaactatatttaaaaattattgtaatctttgttcatctcaatcaatttttgaaatttgacatactattttaataaaattgacgtgtcttcattcaagtaatttatttatctctttaatttattatttaataaaattgattagttattattaataatgataacatttattatttttatttatatataatacaagtatatattttttgcaaccattttttcttctttaggatcatacatgactacacaaaattaatgacaacaataaaataaatagattaaattggcaaattcatatccaaaagttaaagaaaatgtttgtcttcaaacatttaaaagagtggaaatacttcaaattccaaacaaaattttattaatcattctaattaaaggttaacatgatatgtaaaaatctaatcaacctcaacaaaagggatttagttaatataaagaaaattgaaggggaaaaaaagaattatataaatacttaaagagacatgagttactacttattacatccagattcaaactcacactaattaatttgagaagcaaagtccttaattacagctaacatcctaattttgatatcaaggaactaccatagaactgcatttagcatgatcacaaagttctcattcattatccttgaaaaggtgtggaatattttgttatttatcttataaattttttaacgtcttgatgaagggaagactcgacaataactacccatagtaattattgtttattttaagaatattattttactcaccgtgtagaagacaatctaaaaagttgtcaagcataatacttatcatttataattatttatagggagtttctagcgtctaactcaaaagcaaaactcaaaaagttgcaaatataataatacttgtcatttctttaggactttttttacacgtctttgacgatcaagacttaaatttgaaataggaaaatgacaaggtaaatgaacaaagcaataacaaaaaggtagcagaaattaatttgatgacagatttaattaaaactaatttaggcataaaatcattgtagaaaagtgaataagaaattttttaagagattgatttgacaattattttttttaaaaaaaaaaaactaatacaatctactgtataatatggaaggatatcacgtgacgtttctatatttatttcttccaaaattattctgcagttatttattcaatcacattactctgtctgcctataaaccatagtgcaaggcatttttaggggcactttgatggatagatagatagagggaaagggatagagagagagagagagaggagagagacctttctacaagaagcatatgcttcttgcacagttgcaccaatgatgccattcccacacattcaaagcaataatcagctcccccgccagtcatctctatgataacctgctaaacaagcacatatgagaaggaaatttcaagacttaaggcaactaaattaaataaagattggagcctagaagagggtagacctggctcacagatttgttttcactttctccagcatggacaaagtcagtgagcccaaacatttttcctgagtaaatcagaggaacaaacccacaaaatcaattacataatttgagcacaataatgacacaaaacaaaatttgtttaagcattatcattaagcagataatgcgttaccagtttcatatttttctaggttgaaatccatacctataatcctatttgctccacaaagtctagctccctcggcagcctaggtaaccattcacttgctatgagcgtttgagtataataaaccacaaaacacacaaaagaaagctatgtggattccttactgctaatccaatacttcccaacccaaaaatggctactgtagaccctggctccacacctgctgttctccaagcagcacctacccctaaaagtgcaagtttaatcaaaagagtgaaaggcatacactcactcacctaacagcctcatgacccaagattcttgtacaaactgcaggagggacctttaatatagaaaccactataaatatcaagtgaatagtataacatgtttttaatctcgtggatgtgtaacaaaccaccaatcattttatgaaagaaatcgaaggatgaaataagcaattggctccagttttttgttttgcacagagtagtgtttatatatgataggcgcatcatatttaccaaaatgtcaccaggttacacactagttttgagagtgcttatgcacactcttcatgaaagaagtgctggtgtttatcaataagagaaatcattaaagcttattaccctaagtcagattagagtcgaattattagtttttgaaaatattatagatgatgttgtgtaaagaaaattaataaatactatatataaatctgcagccatcaaatacaaactcgactgtgtgcagttagaaagacgatcagtttacgaggggatattgaccatgttactggcagcttctttacaaaggagttcaaaacgcctcttcttatttttcatttttttaaagtactatgggtgattcttttttgtttgtttttacttccgtaaatgaaaaatagctacgaaaatataaattttgcttatgaaggttgttgagaaacggggaaagtgtgacaggtttttcgaaaagaaaaaagggaaaaaaatgttacacaattagtccaatgacaacaacacaacaggttatgaaagaagttgtttgccatcctctatgatcaaatgggaaatacataaaaagttgtgtgtaattattgttacaccagaaaacccgatcaatactacatagtaacttaaaattttaaactcactctccatggctgcgaaaattcaaactagtttttgtttacctacattctccatcccaacctcaaaacccaaaaaaccctacttaaactcgttcaccgtctcagcctccaaatccatctcggaccgaaagctccgggcggcagtgaccggcggcgtccccgtcggatcctcctcggcggagaccctagcgtccagcgatctcgagaccttcctcttcgaacgcaaccgccgtccgtcgcgaagcggtgcggcggcgccatccctctctgcatgctcgaagagttcgacatccctcaccacatcatcgaccgccacgtgacgcgcatgcacatcttctccccttccaacatcgccgtcaacttcggcaaaaccctaaaaccccacgagttcatcgccatgctccgccgcgaggtcctcaactccttcctccgctccctcgtgcacgtcgccgtcgctaccgaggtctccggcctcgacctccccgcagcgccggacagccctacaccgtccactacaccaccaacggctcctcgcgccactccctatctgtcgacgtcgtgatcggcgccgacggctccaatagtcgcgtggccaaagccgtcggcatcggcgactatgccgcgcaatcgcgttccaggagtcttttatatttttatcccttttaaatacaaatatttaaaactaattaattctaattaagatttgatttaacttttgattttaaatcataaactacataaaacaaagatgttatttttataaactatatttaaaaattattgtaatctttgttcatctcaattaatttttgaaacttgacatactattttaataaaattgacgtgtcttgattcaagtaatttatttatctttttaatttattatttaatgaaattgattagttattattaataatgataacatttattatttttatttatatataatacaagtatgtatttttgcaaccattttgtcttctttaggatcatacatcactacacaaaattaatgataacaatgaaataagtagattagattggcaaactcatatcccaaagttaaacaaaatgtttgtcttcaaacatttaaaagagtggagatacttcaaattccaaacaaaattttattaatcattctaattaaaggttaacatgatctgtaaaaatctaatcaacctcaacaaaagggatttagttaatataaagaaaattgaaggggaaaaaaagaattatataaatacttaaagagacatgagttactacttattacatccagattcaaactcacactaattaatttgagaagcaaagtccttaattacagctaacatcctaattttgatatcaaggaactaccatagaactgcatttagcatgatcacaaagttctcattcattatccttgaaaaggtgtggaatatttttttatttatcttataaattttttaacgtcttgatgaagggaagactcgacaataactacgtacccatagtaattattgtttattttaagaatattattttactcaccgtgtagaagacaatctaaaaagttgtcaaacataatacttatcatttataattatttatagggagtttctagcgtctttaactcaaaagcaaaactcaaaaagttgccaaatataataatacttgtcatttctttaggactttttttacacgtctttgacgatcaagacttaaatttgaaataggaaaatgacaaggtaaatgaacaaagcaataacaaaaaagtagcagaaattaatttgatgatagatttaattaaaactaatttaggcataaaatcattggagaaaagtgaataagaaattttttaagagattgatttgacaactatttttttttaaaaaaaaactaatacaatctactgtataatatgaaaggatatcacgtgacgtttctattttacttcttccaaaataataaatttaatgataaatgtaatcaatatcattttttatttattcattaataatagttatcttttaaatagtcaccttaattttaatatatttctttcaggagaattaataaaaaatattttgcaattaattttttacattaactattatatgaatttaattttaattttttaatataattttaattttatgtatattttagttccatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaagtaaaaaaaaaaaaaaagaagaagtagacaattttagtaaccttttaattatttgttatagttatgtttaataatcaatttacaacaactcttggtgtaattaatatgtttttgtattataattcgaattcttctatagtgtttttagatatggttatttttgagtaaatgattcaaatcccaagattatgaagaaaattatgaaattgtgaatccatggaataaacatattctcttaaagactaaataaaattatcatattttaaagaaaaaggatttgatttcaccaatagtcacatgaatacgaatgcagcgataatgactgcttcacaccaacaacctccattgatgcactcattctcgttaaacaaccttcacaatgaggaagttgtccctccaatgttcaaagcaaaaatgattgaagaatgaattctgggtttcattaatgcaataacaaagggacaaatacaactacaatgatgaccacatatcaatcacctttgatgaaagtaacaaaatcaccttcattagggtgtgaaggagaagaggtgattttgtgcaggagccacaataattggatcttcttattccttttccctaatttcattcttttttatttgattaaaaaatttcttctaatttttactttttattttgttaaaattgtttaataataaaataatatttttttaatccatgtcatgtgtgtttgatggggatcacccactgtagaatgatctgcttaacattttgcttaaccaaaaacactataaataaagtaaaaaaatataacatttagaggaaactataattaactttaacattgttacaagaatcaattagtagcaaaattataaatatttaaactttttaatggttggcaatataaaaaattatctaaataacataaaattaatttgataatgatttacaaatatattattatatcacaggcgaaggaagaaaaaacaaagaaagagttaaatcgaaatgaaaggctttgaagcagcgtaggctataaatagaagttcgtgaattgaaatggttgcatccaaaatactctctagttttgttgttgagttgaaaggatgaatatgaataacaatgtttggtgggttctactcccatactttctcttccttcttcttccttcttcttcttcctctttctgcaaccatgatgacagctctgccttgctacaactcaaatactcactcaaaacttcaaatgattttccttccaaaacagaattttggaacaacggaacagattgttgtgggtggattggggtcacgtgcgacatcatctcaggccacgtgattggtcttgacctatcctataatcatttttttggtgacattccctccacaatctctcacttgtccaaattactgttacttgatctccgtagtataaatgaaggtccgagaatgaaacttgatccatacacttggaagaaactcattcaaaacgcaaccaatttaagagagcttaatttagatggcgtggacatgtcttgtatcggagagagctctttgtcattgctaaccaatctctcttcctctttgatctcccttagtctctctgacaccaaattgcaagggaatctgtccagtgacatcctctgtttacccaatcttcaaggactatctttgaatgataataaagacctcggaggtgaacttccaaagtcaaactggagtactccactaaggtacttggatctctctattactgctttctcgggaaacattcccgattccattggccatttgaagtctcttaacacactagatctgtttggttgcaattttgatggattgcttccctcatcattgtttaatctaactcaactctcctttttatatttaagagagaataaattagagggaccaattccaagcgaaaccaataaactttcgaaattgaaatttctatatttgtcagataacaagttaaatggaacaattccacgttggtgttattctttgccttccttggcatggttggatgttagcaacaaccacctcacagggtcaattgacttgagtggtcatctgcactttaatcaattttcaatgttcaaaaatctagagcacctcgatttttctcacaatagttttctctctattcactttcatagtaccgctgattcaaagttcaaaaatctaaatcacctcgatctttctgacaatagttttctctctattattgttgatagtaccgctgactacatcttaccccaccttgatcacttatatttatcttcctgtaatattaatagtttccctaaattcttagcaccacttcaaaatctgctcgcactagatctttctcataacaacattcgtggaagcattcccccgtggtttcatgagaagctcttgcactcctggaataacatgatgtatattgacctcagtttcaacaagttgcaaggagatctcccaattccacccaatgccattcggagctttttagtctcaaataatgagctgactgggaacattccttcagcaatgtgcgatgcaagctacctccagatactcaacttggctcataacaacttgacaggccagattctgccatgcctgggaacattgccttctcttttcgcattggatttgcaaaacaacaacctttacggcaacatacctgggaacttttcttattacggaaatgaattggagactataaagttgaatggcaaccaattggatggaccattaccacggtctttggcccactgcacaaagctggaagttttggacctgacagacaataacatagaggatacatttccccattggctagaaagcctccagcagttacaggtactcagtttgcgatcaaataagtttcatggtgtcatcacttgtttcggtgccaagcattcatttcccagtttgagaatttttgatgtctcaaataacaattttagtgggcccttgccagcatcatacatcaagaactttcaaggaatggtgagtgtgaatgacaaccaaactggtttgacatatgtgggtaacgccaatttctataatgattcagtagtggttgtaatgaaaggtcaattcgtggagctcaagaggatattaactattttcacaaccattgatttatcaaataatatatttgaaggagaacttccgaaagtcattggagaattgcattctctcatagggcttaacctttcgcacaatgcaatcactggtaccattccacgatcctttggtaatttaagaaatttggaatggttggacctttcatggaaccagttaacaggagagattcctgtggcttttaccaatttgaattttctggctgtgttgaacctttcacaaaaccacctcgagggaatcatacctacaggtggacaatttaacacatttgaaaatgattcctatgttggaaatccaatgctatgtggatcccctttgtcaaaatcctgcaatgaggatgaagaaaggccgccacattcaacatttcaccatgaagaatcaggatttggctggaaagcagtagcagtgggatatgcatgtgggtttctatttggaatgcttttgggatataatgttttaatgactgggaaaccacaatggctcgcgagacttgttgaaggtgtgcttaattaattaacagtgtaaaggacaaatcataggggaaggaaatagtttactcttagtttaatatggttcttttgtgtgtgtctgtatgttttctgtaattttaacttctgtctgtggaagaaatatcgtctctggtgagtgatctatttcaagttgtttccaaataagaaaaaaaattgtgatgaatgctttggtttcaatttcaagcaattaattttccgtaaattgacattatattcggaacatatatatacagttctctggaagaattttggctaacacaattaaatgtacaattgtatcgttgtattttcagatatagttggttcatgatgaatgctgttcagcatcaaagctactgagaaaagaagtagaaaaccaacctttcggtagttttagaatttactgcggatgaaggttctgtgggtcttctgtctttttctttactaacagcactacagaaaagtccattagtttaagatcggtatgtttttgcttagtgaaaggactttatgccaaaactccaaccagaaagagtaggatttcttatttgccaaaacaaaggctatccttgaaacaaagtatttaatagtaaaagacggagaatttgcatacaaatggattgtcgcttgagttaaaaccttctttcaactctctgttctacaaacagatattgaagttgataattgatcctgatgcagcctctggaaagactgatccatatgcattacaaaatttctagacaaaggcaccagagggtaagcatgttcttgaaattaagggttgaggtaacattagaatcagataatgtacctcaattgtttttaaaaagcaatactaacaatataatcttgtttaacattttttttattattgactaaatttgatgtgaattctattacaaaatttgagtgatgggatttacgtaaaattcactcaatgattaaagatttgtcaaagggactttctagcatttcacaactgccaaagagttttacagactccattttggcatcttaaatccatttgttaaacgtaattttttccttaaaaaaaattgttcacgtgaaacgtctcaaactggatgtgaatttcacacattaatacggtaaattaaaacatctcaaactgtcatttttttttatctgtatttgtatgtttaaacatcttaatagtttgtctcttttcatctaccatcttttatcactattttaaatttgaatttcaatagttcttataaaaataaattatcaatagttaaaaataatattatatcataatttaaattattcattataaatttaaaatataatttatatattaaaaatatgctgaaacactttttattagctgaattttaaaattatttatttatgatggattttaatgatataaaaataaatttaatatgattctttcgtgcgatgcgtcttgttttctgtaattttaacttttgtcttttgtggaagaaatctcacctctcctgagtgatcaatttgaagttgtttgcaaataagaagaaaaaaaatgtgatgaatgcttttgttttaatttcaagtaactaattttccgtaaattatctagggtaacctgcataagcatcaaggaaaatttgcacattgaaccttcaatcgacacacaattggcattatattaggaacatatgtactgtttttctggaagaattaggctaacagaattaaatgtacaattgtatcattgtattttcagatgtaattagttcatgatgaatgttgttcaggcatcaaagctactgagaaaagaaaaaaagaaaaatgaaaatgaaagtaacataagaataaaaataatttaatttttaatacaaggtaattagctccttaaggttactttctagcatcattccaaagtcttccttttcttttggctgcatcttagctctctgcttcatactcttgtgggttgctagttggaatgttcttgggctgtaatgtattattcactggaaaaccctaatggattgcgagacttgttgaaggtatgctatatgtcagaaaattgtcaaggaatgaattagtttaatatggttctgtattatgtaggtttatcattatgtatttatttgccgtaagttgtctgacttgtatcctgcaaaggcattgaggaaaattcacgcgtttaaccttcaatccacaaaaaaatcagcatttattaggaacaaactcatacagttttcttaaaggatttacaatttaacaattgaaagtacaagagaatcagtgtattttagattttccaagcaagctggatttgtgttgtattgtttactagaagccatactaattaccgtagtggatataaaatgaagcaggaattcaacaacataatggtttgagatgaaaccttcttttaccagaaaaattaagatacggaaattgacataatggtttatcctaatactgccttggaaaaaaaaaaaaaaaagatatcggcatagaattaatttagtcataaaatcattggagaactaaaataatgacaaagaaattttgattaatttaatttgctgcatgatgattgtagatgcgcccaggccaatgtgttccattgggagatttcttaactgaaaatatataaataataaccataacaataaaaaatttatatattaaatatttttaaaatttataaatttgtataattcaaaaaataattaataactttttatgaatgatacatacaaaataatgtttacaaaattaactaaatgaattaactattttaataatttttcttcttattactgtgcattctattcggaggcttcacactagtgtaggtaatggggaagaaaattgtaagcagcatcacccttgcatatacaaagaatagataaactaaatgtcatgatttagaaataaggatatcaaaattacaatttagcccaaatatttttatattttcatcccttttaaatacaactacttaaaactaattcaatctaattaaaattttgattttaaatcataaactatataaaacaaagatttttttataaaatatatttaaaaattattgtaatatttgttcatctcagttaaattttgaaatttgacatatactattttaaataaacatgacgtgtcttgattcaagaaatttatttatctctttaatatattatttgataaaattgattatttattattaataatgagaaaatttataatttttatttatatatactacaaatatgtattttttcaactatttttccctctttagtatcatacatgagtatacaaaattaatgataacaatgaaataagtaggttagattggccaactcataccccaaagttaaacaaaaatgattgtcctcaaacatttgaaagattggaaatacttcacacttcaaacaaaattttattaatcactctaatttagattaacatgatctataaaaatctagtcaacctcaacaaaagagattaagctaacataaagaaaattgaagagattgaaaaaagagattaagctgtagcagcgggatatgcatgtgggttgctatttggaatgcttttgggatataatgttttcatgactgggaaaccacaatggctcgcgagacttgttgagggtgtgcttaattaatgaagttgaaaagaacaaataacagaacccatgctaattgacaaggaatgcattagtttcatatggttctgtattatatgtgtttatcagtatatatgtattttgtttttgtaatttttatcttatttgtttgtgtaatgaaatttcatctcaatattatcaagtgatctatttcaagttgttgtgcaaataagtaaatttagagatcaatcaattttgttttaagttcaatttatttgccataaattgtctaattagtcgaatcctgcaaaggcattgaggacaattcacgcgtccaaccttaaatcatcacaaaatcagatttttattaggaacaaacttggacatttttattaggaacaaacttggacagttttcttgaagaacttagattttcgcaattgaacatacaacaaaatcagtgtgtattagattttccaaacaagctagatttgttttattgtttactagaagccatactaatacggcagtagatataaaataaaacacgaattcaacaatatgttagtcttttgactgagactattttaagcaatattggttaggagttttttggttgacatcgattaagatttttgatcaacttggattgatacgtcaatgactcaagccgatattggcaaaaagatagccttgatcgatgtccctccaaaatagctttagttgatgtgactaaaaaatattatcgattgacattgactagaaaatatcctagttgacgtcaatcgaaaatagtcttgactgatattgacaaaaatcaagatcgatcaatgtagggcaaaaaaatatcattgactaatgtcgattgaaaaatctaaccaaagtcaacaaaaaaatagtctgattgttatagagtgaaaaagaccctagccaaagtcaactgaaaaatagtcacaaccgatgttgattgaaaaaatcctaatctatgtcaacaaaaaaataaccctacctaatttcgtcaaaaaaaattatcgaccgacattgacaaccttaacaaaaaatagttccacattgatctaaaatagaatattaatgttggccaaaaataatcctaacagaaaattaacaaaaaatagttgcgatcaaggccagctaaaagcaaccctaatcgaagtaggttgaaaattgatttatgatttaaaattagatttaaaacaaaaatagttttgaaatataaactaatttcaaaaccattttaaattgattttaaaaaaatccaaactacttttatgcacttaagtggataatataaattttaaatccgattcatttaattggatttgaattattttttgaaaatccattccataaacaccctaaccttggtgatgtcaaatttacactacctaaaactctcaaatatacacgtttcataaacaaaagtttcagaacattttggggtagcagtaaaaaaaaaaaagttaaagaaatagggcgctaccgcactgcaacactgttgggtatactttggaaatcatttctttattagaatcacacagcacaaaatggttttgatatcgacattaaactatgcatttacaatattaaataagaacttgaaaaaaataaccaatatacaactttgctaaagaaaatgtaattattaatatattattactaaaacacatggaaggaacaaactagaaaaccctaattcacagatattcatccaaaatcctaactctctccatggctgcgaaaattcaagctaatttttgtttatctacattctccattccaacctcaaaagcctacgtaaactcgttcaccgtctcaggctccaaatccatctctggccgaaagctccgggcgacagtgattgatggtggcctcgctggattctccgcaacagaggccctagcctccgacggcgtcgagaccttcctcttcgaacgcaacccagcatccgtcgtgaagccgtgcggcgcgccatccctctctgcatgctagaagagtttgacattcctcaccacctcatcgaccgccacgtgacgttcatgcgcatcttctccccttccaacatcatcgttgacttctgcaaaaccctaaaaccccacaagttcatcgccatgctccgctgcgaggtcctcgactccttcctccgctcccccgcacatgctgcagagggttttctacgtagtaacgtgtccaggaaggctctggtggaactgtgtggggatgagtatgttcaacgcatgatgtttgagaactatttgtataagaagttggcacgtgggagagtgttggatgatgctaagcttttcgtcaataccattgggagcttggtgagatctaaagtgttggaaacaccacgcatggagagtttgatactatgacttcggaaatcccactaagttattttctagctcttatttgcaggaagccaatatgaagaatgttgaagcatagttgaaaacaaaatgccttgaactttctgtactggttaatttcataaagtgaaccaagataaaactaatattttgtgcttttttttcttgcaatattcattattattcaggaagaagggaaataaataagtcagaccttctgcttacaaggcacccaaataatatttgggagttccctgaattaccaaacaaaatgtgtcacaatgtaaatattttaggtttataacctttaggcgtatgtagaatccaccacactccggtgccgatcgaatacatgtaatgtagtattatgtgatttcaccatataacggagacacattcgattaagcatccgcgtcaagtggaatggaatacatgtcattcatgatcattgtaattatagcttaagcttgcttttacaatggaaattagtcatcacagaaaatagatactagtaaaatactttgaagcattgttggtgaccatcaatttatttgacataattactttgctgggcatcaactgcttttacattgaatatgttttctccaaatacaaaaaaagaacatccaatatttcacttattatgtcataattcaagggcttaagtaacgaaacaataacttatacaagaatgagatcatttgtccatccaaatcacacatcgaagacactgtccatcaatcaataaatcaaaagctttattgatatccttgaactccatctcatgtgtgacaaactcgtccaaattcagttcctgttgataaaaagaagcatccccagaacttgttattgctattatgttatgtcattgttatttttacataatcattactaattactagttttacacatattaatagatgggacaaagagcatagactaaaaaagattaagtaaaagaaattgcacatagtaccttgtccatgtagcgtttaaggagaatgggtacatgagacttgggcttgagtcctccaaataagcatccactgaggctcttcccactaacgagggggtttaacttctcacaccaggcaaattttccatacacccaacacttttgtcaaaatgccaatattgcccttgtctgttttgctttgttttttttcgcatacaccagctgaatgcgtcgtcttccttctcactcctgttcttggttctagcttggattcttcgtggttgttggcttgttggtttggtgtggaggtcgttgttagcagtcgtggaggtttcattggccggaatcgtcgtcggaggtaagttctggcgttgttactgtagctggaaacactcgtacggattggcaatccatatgactcatacggatcggcaatccgtatgaggcatatggattgccaatccatatgactcttacggatcggcaatccgcaagagtcatatggattgccaatccatatgactcttacggattgtcgatccgtatgactcttacggattgccgatccgtatgaaatcgaatggtgtatgttggtatgcaacttacggattatgagaagggtaaaattggtattatactgtgcatgttgggtgtattggaaaaatgaatggtgtagaaagttaatcccctaacgaggacctcactacagctaaggttcaacttggatcctggcttgtccactcccaaaactattgtttttccccgaccctgtaggcaaagcattagttttaacaattcatgcattcaacaagtatgcatcagttaagaaattacaatcaagcctacctcaaatttgaagggaaacttcatttcatgaagtactaggaagttgaaattagttagcacaaaagaaaactagtaatacttttagtggattttcaagctttgtgctagggtgatagtagaaaatcatgttgtagttattgttttacaatataatcgcattattctgtctgcctataaaccatagtgcaaggcatgtttgtgcacacgttgagggagagagagacctttctacaagaagcatatgcttcctgcatcaatgatgccataccaacacattcaaagcaataatctgctcccccaccagtcatctctaagataacctgaatcacaaccccgtatgagaagaaatctaaggactcgaggcaattaattaaattaaattaagattggagcctagaagatggtagacctggctcacagatttattttcacattctccagaatggacaaagtctgtgagtccaaacttctttcctgaataaaagccgaggaacaaaccaaaaaaaccaatcacataatctgagcacaataataacatagacaagaatttatttaaacattactgcttaaggaaatgcttgatgtgatattattaaacaaaaaaagcattaccgatttcatatctttctgggttgacatccactcctataatcttagttgctccacaaagtctagctccctcagcaacctatgataccaatggcttgcaatgtgcatttcaatataattaatcacaaaataccgaaagaaaacagagctaaacggacaccatactgctaatccaatactcccgagcccaaaaatagctactgtagcccctggctccacacctgctgctctccaagcagcacctattcctaaaagtggaagtttaatcaatatattgaattcatgaatgttattgagtagtgatttaaaatgtaaaaacaaccccttgtatttattataaccaaaatttatactacctccagtccttattataagaatttacactatcacttgtttcttataatataaggaccagaggtagtattatgtaacaaatagttcttctctatattaatgtttgcatggtttaggcaaattacccgctgatataccacagccgatgaggcatgccctgttgggcagtattaccggatcaatcttgattagatgggcaatgtcgaccacagtgtactcgctaaaactagaaacagacaagaaatcgtgtataatctctccttttaaatctgtgaatctagaagtggcatatctaggcatccagggagacacctcaaaaaggaaactttgaacaaaggttgctcttgcttgatttgcaatctacgcactccccacaatcaggtaagaaaattggaacaaccacatctccttttgtaacttcagttacatcctctcctacgctttccacaaccctggatcacataaaaaagccctggaattcatcaacagctcctatagtatcaaattaaatgtctgaacaagtagatccaatggggcttaaggtggcaaatcattggcagccaacaggagacaaaaggggtaaacatattgagttgtagaatctcttaataaatcaatggccaaattactgtcattgaataataaacaggcttacagatatgcctctttcttaataaaatccatgctcaatattgaaatttgaaacactacgatttgtctcaccgaccatagttattcattcttctccctaaaagctggatttaaaaaattaactactcttgagttggctcttcacaacttaagtgcatatgtaacacagaaaacacatgaaattaaacgaaaaaggcaccaaaacttatgataggaactgtttttctgaggagtaaagactacaataaattttctgtaaacaaaaatcaaagcaccaaagtttactctaccaaaaaaatgaaaaaagaagaaaagtttatattgatacaggaaaagcatacgcatttagcataccatcaaggtagtggaatccttatgagaaaagagggtgcaaaataaaatgcataaactcaccctattgcctcatgacccagaattcttggataaatggcaggatggtccttcaaaacatagaaaatgcatcttaaaaaaatctttcagaaatttccatagaaccaaaagaaaaagttatctaaattctacagcaattgaattgaaatgaaaaggtggtatagggaaggcattggctgagaaaaatgttccaaatcacaataaaacatttagagggaccaaaaatggtgtcaagtggcaacctgcatgttccgaaaactgatatcggtttgacagagagaggagcatataatacgaatgtgagcttcaccaggcattggtggtgccacaatgatctcctcaatactcagtggctcactgggtttgcgacaaaccgccgctacagtttacaaatgaaacagaacagatagagttcacacatatgaaacatgacatacaattaagaaagccattaaaaattactacaaacaagaaaatggtagagcagagacaacattagtttgttttcaggaatgatggcacaccacacacctttacatcttatgggttgtccttcagttgttgtggctactttgtgttccatggctatccaaaacacatgaggcaatgcaacgtgttagtgtaattgtatagaggatttgggagctgatcaatgaaatattaaatatactaagtgaaaactaacttgatgagtgatatgactaaagtttagagaaagtgaatatagaaacgtcagatggagacttacgaaatagggacaattatattgtacaaaccaagtacaccgacatttttgcttctgttgcgaaatcggcaagtataccgttcgttcaagtaataaagtgataagggagttgtcgttcccacaaggattgatgcactaattatattgtgactcgtatctataagttggacaaataaatgttggtaaaagaatgagttggttgtttgagtaagtaaaagtaaagacaagaattaaaacataactattgattataaacaacaaagctaaattaatgacaatatggaagaagagtagtcagggcacccacactcgatgattccttccaatggatgcgtattgcttactacattcaattatctaagttacttagcaattgtgtttcatcacgtattagttactccccaatcccttagtgaaataaccctttaaccctcttaaaagtcataatcccttagcaacctttttagggttaagcattaagcaaacactttgaataagctacaaacataaactcctattcctaggtaatgtaagcaagtcactacacttagttccaagactagaaccccaatattcctattgtgaaccctagctcttaacccttcatttgattgatcaagtctaagaaatagatagaaaccattcaagcaaagtgcagtaaaataacttttgataaatgaataatagcattcaatacattccaatggaagtttaaatcaagtgcttggccctagctacaaatgaaactagtcaaacctaatccatcaaaaagaagcatgcccagctgatacacaagcaaggagaaggtagagaagaagggaagaatcccatttgcactcacaactccaagccctagctaagctcccaagctttctctagccttgttctagtgaaatttcatccaagagtcctctcaaagctgtgggttttagtatttatacttagggaggtgaaactccaagtttgccctcagcaactttcaatttctgcagagatcgaggtcccgcgcagatagcgcaaggatctagagaagatccactttccagagcagttgtggcgcggatagcgccggacttggcgcagctggcgccagaatccggagagtttttcatttggaaggcactattggcgcggatagcgccaatctcgcgctggcattcatagaggaggctttgcttcactggttggcgcggatagcgccatagatggcgcggatcgcgccagattttcactatttcttcctctgcacttcttttgcctcttttcacctgctaatcacttaacttgagaaaaagcatcattgaggaagattggtcaatatttatatcaattggaagcatttatcattaattctaatgcatttggtgatatatttaagcttgaaaatgccttatgctaggcgcatatcaggttcccttgaagctaccaaactagaatggtttcatttttgcgagtcactctcagcctcacgtacctcatcttttatactaactagttggtaacccgtgcattcgcacgggatgtatcgatttgttgtgctttgctctgcttcaaattgaaaaattatttttataataagtaaacatataaatattttagaaatgaagaaaatgaatttataataggaataaaaaattatgtttgttgtgtgtaatataaagatatgacaattataagtaaacacacaaatgaaaattgtaatacttatttgtgtgtatcttttgtcttcgattatgtctgttagcattccttttgcatgtgtaataaagaaatattatttaataacaataggtatatagatgtaatgtaatataattgtaggcaccagaggatgattttgtaatgtagtactccttaacaattttgttaatatcttacaaaattctagcctagaaatagaatattttctataaatgtaactgatgggtcacaacaattttaaaaagattaaaaatttaaataatttgactggaatatgactaatatatggttgattgagaacttattagaatttcaattcatataatcactataagataaagatataagattgatagaaaaaattagcttgaaaaaaatactaatttttaatctaagtaagaattgtaatatgtagcaagcaacttttagttatgaacttaaattaaaaaaacaactgaaaacttttaacaaaattaatgctatgctagtaaatttcccacttgttgaagtcttctatttcaatttacccaaataatacgttcatttccttccatttgtcttgcatcttttttccactctaaaccttcatcttctacttaatcatcaactggattacttttattcacttttgtttgtgtcaatgctcacttttatagaggtcctgcttcaaatttcacaattaaacattccattgatcctttaccggttcacctaaatttttgcaatagacatcaatttccatttactaacttttttaaaacaaatataattgaactattgattataaataggagtaatattaacaaaagataagcaacgacaaccaaagattgtatgtgaaaaaatcctattctataagagaataccaatctgacggaatcaactgaaaagttctgatgtgaaaaatcatctcaaaagtgtcataaatttagaaataaaatgagaaataaggaaacatatccaaaaaggtcattttgccatttgatcaaacacataatttgcaatcaataaatcagtctagaataaaatcaaataaatatttaaaaaaattctccaattctcatctattctcataaagacccgtttaatatcttttttcacaaaatattttaatccataggccatatcaaataaacatttttaacaaatttagttcatattcacaatattaaagaaattttgatgaaggagaaaaatcaaagaaagtaattaggtcaaaccaaaatcaaccaagaaaatagaaactaagaaaattgttcattgcttacatatcactataaatcatgaaaaaattatgaagaagttgtagtcacagtggatggcaaagacattttcaacgagggttgcgatgttgaatggttaacggagaaataaaaagatatttcactggtttatttttagaagagagagaaaataaattgaatgaatgaagaaggtaagagaagagagaaaaatggtgagaaaatagagaacatcaaagaagaagaatgtttcagagttgagaaaagagagaagatgataaggaagatatttaaacacacctaactcttaaaaaggtagttaagacaacatatcatctagacggaaaagatatttaaaaaattgcaagatctagtatggtttattaatgacaaaatggatgtgcaacaaaaataagagaaaaaaaagaagtgaagttcaataataattttttcttcttgtgataatatacctctgttgaaatgaggccaaaagcaattgatccacttaaggttttatctctgtgcaaacttgccaataattagactcagccaattgaggtgagaaccaacaacattgagaaatatgaagggaccacaagagaaaattgtaaaaatcataacataaaatgaaagaagaccaccgcactatcaagtaaattaataagagaaagaaaaaagtggagttcaataataatttattcttcttgtgataatacacctctgttgaaatcaaacattaaacaatgaatccacttaagactccatctcttattacgcctgtgcaaacatgtcaataagtagactaagtcaattgagatgagaaccaacaatattgagaaatatgaaggacccaaagtaggagattatgaaaatcataacataaaatgaaaggaaattactgcacctttttagacagttgttaagtaaataagagaggaattactatatcatcagtgattcagagtttttccgaaaagaaaaattaaaataatattgagattttatatttttgtaactggctagtacgactgactaagtgttaaagagataacgtgtgagagggatgaaagaaatatagatttttttttatcaaaaaggggatgcacttagcaagttctaatttgaaaatattggggtgcacttataaaaaagggtgtgcaattagcaagttttaatttgggaattctaatttgaaaatattggaatgcatttataaaaaagggtgtgcaattagcaagttttaattcaagtgcacttattaaaaaggggtgcaattagcaaattaatgttcaattaccattttacctccattttttaccaagtgtcataaacataggatatccaattttgtaattttgctagcagttagtttttatatatgtatagtagattatgagtctcattttgatgagttgataaaaaagaaataaatagttgtttgttgattatgaagtaaaagttttagatgcacccacaaatttctgaaaaaaggtcgttttagttcgatgtttgtgttatcctttcttatctagtttttgaggaatcaatcttctactgtgacattactattattatacaagattctaattttttttaataatttttatatattaattaatgttatatatttctattttaaagttgaaatttttaaaaataaacaattaggtcctgtttctgcattactgatgtgataactggaaaattaaatatgggaactttgaatttccaaactagagaaagagacaggtattaactgccatatattgtgcatgatttgtggtccatttttttttttttttttatctaaactattatccactgttcttctataagttctggcgtgacatgattccaactctatcttcaatgctctaaaaaaaatcaaggttttattggtatttctctctctaatctcactttacagtttcttttataaaaaatcataagctttagcacttacatatttcatatgaattaacttttgatttctactggtaatatcatcagtaatgtgactgaaaatacaccagtacaagatacttcttacagtacaaaattgttaaaattaaaatttctttcacagcagaaaaataagagaaattgcgacgtgttcaaacttattatattctcagttacttcggaaatgtcttgatatatagatagtgtaacagattcaccgaaagaggctgatttttttatttttttgcattattggcttgtttaataattttgataagttattcatactctaggatgatgattgtattattaccaccttgatccagattcaactaatgcaatcattgacattatttcaaataaactatttgcgtatcaatatatgccagaggaaattgagaatgacataggtttaagtagattgtgatttcctttattttctatgatgcgaaaaatttgtcgctgttttgcatggttagaaaaagtttatagtagtcttaataagcaacactgccaatcacttaagtaacgatgttaaccacaaaaataaacttatatgtgtatgtaaatgattaaaatttaaatttttttatagaaaaaatataaagctggaacataggtagggaacaatataaattaaaccataaagaaataataaagatataaatagaaaaatatattatttggatgaataaaataaaaatagtataaatgtataaaacaagcatgttaccgatgaaattgtggtggattgtcatttgtcacttatggcctaagcttgtttttcaaatggaaattgataatattcaatgcatgattatttgtcacaaaaaaaatgggaactgctacacgatgctgtttcagggaaacagataatataatacttttaagcattgatgatgataatcaacctttttaacaattactttgttggggtatcaactgcttttacattgaattgaatatgttttcatcaaatacaaaataagagcagcatccaacattttacttgttgatgtcataattcagttgctcaaagcaacaattacttttacaagaatggactcatctgtccatccaaatcacacaccgaaggcactgtccttcaatcaataaatcaaaagctttgttgatatccttgaactccacctcatgtgtgacaaactcatccaaattcagttcctgttgataattacagatgaaatttactaaaaagaagcatcccgaaaacttggttttatggcattattattttacataatcatcactacgttagtagaagggatcaagagcatagactgaaaaaatttaaaagaaattgcagaaagtaccttgtccaagtagcgtttaaggagaataggtacgtcagacttgggtttgagtcctccaaataagcaccccacgaggctcttcccactatggaggacctcattacaactaaggctcaacgtggatcctggcttgtccactcctaaaactattgtttttccccaaccctgtagggaaagcatcagttttaacaacattcaacaagtttgcatctgataagagtttattattaaaatttacaatcaaacctgtctcaatttgacagcaaacttcattttcatcaagtaccaggaatttcaaattagttagcacaaaagaaaaactattactagtgctaggttgatcctttaaaattattctgcagttattcattcaatcacattactctgtctgcctattaaccatagtgcaaggcatgtttaggggcactttgagagatagatagatagatagatagatagatagagggagagggatagagagagaaaggagatagacctttctacaagaagcatatgcttcttgcaccaatgatgtcattccaacacattcaaagcaataatctgctcccccaccagtcatctctatgataacctgctaaacaaagcacatatgagaaggaaatttcaagacttaaggcaactaaattaaataaatattggagcctagaagagggtagacctggctcacagatttgttttcactttctccagcatggacaaagtcagtgagtccaaacttttttcctgagtaaatcagaggaacaaacccacaaaatcaattaaataatttgagcacaataatgatacaaaacaaatttatttaagcattatcattaagcagataatgcattaccagtttcatatttttctgggttgacatccacacctataatcctagttgctccacaaagtctagctccctcggcaacctaggaaaccattcacttgcaatgagcgtttgagtataataaaccacaaaacacacacacacacaaaaaaaaagaagctatgtggattccttaatgctaatccaatacttccccgcccaaaaatgactactgtagaccttggctccacacctactgttctccaagcagcacctacccctcattgctaattacacctggacattggtgtcaccactttccaatgtcgatgtagtaggcnnnnnnnnnngcaactaaattaaataaatattggagcctagaagagggtagacctggctcacagatttgtttttactttgtccagcatggacaaagtcagtgagtccaaacttttttcctgagtaaatcagaagaacaaacccacaaaatcaattatataatttgagcacaataatgacacaaaacaaatttgtataagcattatcattaagcagataatgcattaccagtttcatatttttctgggttgaaatccacacctataatcctagttgctccacaaagtctagctccctcggcaacctaggaaaccagtcacttgctatgagcgtttgagtataataaaccacaaaacacacacaaaaaaagctatgtggattccttactgctaatccaatacttcccaacccaaaaatggctactgtagaccctggctcaacacctgctgttctccaagcagcacctacccctaaaagtgaaagtttaatcaaaatactgaattagatgaatgttgttgagtagtgaactaaaatgtgaaaacaatcatgtgtttatttatgatcagatattctgactataattcttattatgcaactgatatagttcttcaatattctttttgtttaatgtttacaattttgcatggtttaggcaaattaccggttgatacaccacaactaagtaggcatgccctgttgggtggtattgctggatcaatcttggttagatgagcaatgtcaaccacggtatactcactaaaactagacacaaacaagaaatggtgtatgatatctccttttaaatccgtgaatctagaggtggcatgtctaggcatccaaggagacacctcgaaaggaaactttgaacaaaggttgctcttgcttgatttgcaatctatacactccccacaatcaggtaagaaaattggaacaaccacatctccttttgtaacttcggttacatcctctcctacgctttccacaaccctggatcatatcaaaattagctagaacatcatcatcagcttctataatataatatgcagaagatataaaggggctcaaggtggctaaaaattgttggcaaccaacacaaaaataggtagcaaagataaatataattagtcgtagaatttgttcttaaatcaatgttccgattactgttgttaaatcatctgaaggtttgcagacacactttgctttgttatttaatccttgatcaaaattgaaacattaaaatttgcctcataactatccaatcttttctctaggattgaatatagaaaattaactactcctgatagttagaccacaaagacgcctctaaacaatttaagcagttgttacacagaataccttttttttcttttgaaaggaaaatgtattgaataaaagagcaaaggtttgagcacaaactagtcaaaaccaagccattacatgtataaaagatatagcaatagagcccaaaaagacaagccccctaacttaatacaactgatgtatgtagaaaccacatctgtaaggactagggagtaagaaccacataaagtttgaccaaacatttatatattaaaccacaaaagtttactctacctacctaaaaagtaaagcgcaaaagtttatgttgatacagaaagatacagtacaaacagggtattaataaacagtggattctttttccttaggaatgaataatattatccagtaaataaaattataaaactaaaaagagtgaaagggcatgcactcactcacccaacagcctcatgacccaagattcttggacaaattgcaggagggacctttaaacacacaaaaaaaaaaaaaaaatcttaaaaaattcattaagaagttccagtaaggcttctaaaaaaagaaagatatctagatcaaaagaaagagtgtgaaagtaaataaaaaatggtcaaggaagacattgactaagaaaaatgttttaaatcattcaaagagaaagaaaatgatggtaataacctccattttccaaaaagtaacatcgctgtgacaaagagaagtgcatataacacgaatccgagcttcacgaggaattggtggtgccacgatgatctcctcaatactcaatggagaacctggcttgcgacaaatagcagctacagtttgcaaataaagaagaacaaataagtaccatttattcatatgaaacataaatatcaacttcaaaaagctaaaaatctatttgaaataataaaaaagagcatataaacttttttgtttttcatgaatcatggcatggcacacctttacatcttatgggttgtccttcacttgttgttgctagtttatcttccatggcgattcaaagcaaagatggtgagtcaatgcaccaagttagaagcctaagtgcagcaaagagttgggagctgacctatgaaatataagtgcaaatttgggtcaaagataaatgtgtaatgaattattattatatacaattatacaatattaatattaatggggtgcatgttgaaggaaatgacttatgagtgggtatagaatggtttgatggagacaaattaactaaggacagctacattttctcttccatgcatgtgaagctacctacctagtttggtattatcatgtttgcaggtcaccctcagctatttgtttgttaccatctaaatttagagagaaaaaatcagaaggttttaataatgcatttttgaaatatgcgttttctcaatccaacaaacatcaatagcttttattgactagtttttggttttaacatatcatatatgacaaatttttgtttatgatcatcacttgatgatgtttttctctccaaagtcgtccaaaccaaaatttgcacctacccaccttggaattgcttttgcggtagatgaaaccatgtttaacctaattttagtacgtaatatcaaaggaactaccctcctcccttttcggaattataggcattaattaattatatgaactttaaactattcggaaaatattaattatatttctattactttttagaagaaaaaatttaaacataaattattttatttcaaactttaattatttttacaaaattaattttataagattaaaatcatttaaaattaaagttgatgaatgcacatctaaacacactaaattgtgaagcggccggtcgtcaatttaaaattgcgaaaatatacattcttgattaatttgacatttttgactttttagaaaatgttagcttcactcttgtttattctgctttgtccgttttgtacatgacaacacagaatcacgtgtccagaatcttaattaactctgatcatatatgatcgagatgaatgaataaaccaaattcttgctacacaaagtttgaaggttccttgttagaacaatatcacgttgcaaactaacgagacagtattgcaaagattttgctttggcttttaactagtaaaaacctattatatatgctttggtgccctcaacatttgttttttgttttatatatcttcctattatgctttggaggctgtgattaagtattttgttagtcacaaactccttgtttgtttgttttttgctgttttttttcattccagatttctgatcagaaaaatagaagagtatgcctaatcgaacgtttgatgttatatttatttattgataattttaaataaaagaagaagaggagcatgtttagtaccatacattgttttgttgcatgcttgatagaagttcgagaaaaaggatgcaaatggtcaacgaggaaagtagtaaaatataatcttatcagatagacatgatttaaaagttgaaccaaatgttgagcattaattcatgagttattagtgcatttattgattgcaatttgctatttgtgattactatcttttatttaataaataaaaaattaatacaatccacaattatgaatatcacattgactatgtaactaataactatataaagatgacaattgaactccaaacatgataatataagtgtgaagtactattatagcactcatcttatctttctttctcttacacttattaatttagtaatcctttacggataaacttttttatcagtattatttacaggagaaaagaaagaaaaattgaaataaagattttcataaaagtaactaatgcataaattaatttgtaggaattttctcatattaatttattcaaaagtgattttttaatttatatataagttaatttttaaatataaagatgtgtttttatttttgttcttatttccttcttatttttggacaaaatgatccaaatatgacaaataaaatcattataattttgaaactagacgccattcttagaatataaagcattaccattttgttacttatatataaaacagtataattatgtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataacttttttgtttgtttcctgtacaaatatttgaaaataggatagattaaatataaagtgacagttttataattaaaagtaaaaataaatattattaagcatgtagatcaagtgatataaaattgtttcggcatggtcaagaacaaaaataaataaaaatggaaaataagacatccttgagctaagtttgtttaagcttattttttaaaataagtactttttaataaaataagctgatttttatttttatgatgtatttgtttaaattggttttacataaaataaacagttttctacttaaatttttatgtaatctatttttattatgtatttttttacttaaatttaaacaaactaaatgtttatgtaatttaattctttggtataattttatattaacaataatatttttggtgtcgaacaaattcactataaacaatagagatgacaatggagtgggacggaacaagtttgatgtcccccgccctcgtccctgcttctataaatgtacttttcctatttttgatcttcgttcccatggggatgggtatcccgccctgtccccatccttagtccactgattctgttttttcaatttgcaacagttttttctaagagaatttcaaaaaagatattataaatggtgcacaagaagtgcatgtgattgttaaacaaaaaagcatacttcttgtgttagctagtattcaaggactacagagcgtgcgagtgcgacacgaccttgcatgcaacctttcaagtttgcgaaaccagtgtgtggttcgacataaaacgaagagtatggcaaactaaagttcaacggaataacaacacagcgacgcaacaaacactaccctcaaagatgcgagatcgcgacgtgatcgttgacatgagagataactgtatgagagagacgaggcttggtagtcagtagggatggaaatgggtcaggccaaagcctgacctggtctggcctgtttattataaaggtcaggcttaaactttttgaaaagcctatttaaataaaaaggtcgggctcaagctttaaaaaaagcctattagacttatcagactggcctatttaatatatatatatatatatatatatatatatatatatataattaaaagatataaattaatcttttaaaaaaagaaaaaaataagataaaatctaaataacctaatatacttaaaagataaaaataaaatagaagatttgaaacactaatagatctgtaaaaaaataaaagtatatatatatatatatatattaaaactaaaaagatataaatcaatcttttaaaaagaaaaataaaaataatataatataaaaactaatctacttaaaaagataaaatataaaaaagataatttgtatgtaggtttataaattataaaaaagtaaaagttgttatgtttgttttaaaaagggaaataaaataatataatataaaatttaatctacttaaaaagataaaagataagaaagataatttgtgtgtaagttttatataaaaaaataaaagctgttacgtttgtttcaaaaagagaaataaaatataatctaattaaaaagataaaatataaaaaatataatttgtgtgtagatttgtaaatataaaaaaataaaagcactacatattagtattgacatttgaactcttatatattaaacttatggtattttacttagcttgtttattttgtttacaatattttgttgaatacttaaagtattccaattataattattaattgggttgttgtgattagtaaattttaatctcatattagagtactctaattaattttatttttttccacacacaaattaaaaggaaatatgtgtcttttttatattaaatttacaaaagtattatacgaatcctcgaagttttactatatagtcattagattttttttaatatataatatttattttaaagtaggctttttaataggctcgtaggccaagccagacttttaaataggctaggtcaggcctaaaaaaaaacctatgatagataaaaagactaggtcaggctttatatttttaaattaggccaaggtcaggtctaaccaagcctgacctggcctgacctgtttccacctctagactagccagcgacactaatgagtagtgaatgagtgtgaataccagtttgagagtttatacttttttattgtataagtgtatattgtataaccctaaataatagtaaaaaagtaatttaataaccacaatagacgtcggggatggatacgggaatatatgattactcatcctcattcatgtacataaagaaatcacccaaataatactcgaaccatatgttcatatccagtcaaattaagtattttttgtcaaagttagaatgaggtaggacaagtacatgcgagttcggatttctttgtcatccctgataaataatttagaattaaataattatgtgatatatatatatatatatatatatatatataatattgtgatttatttagaaaaacatattatttatgagtaaatacttactaaatagcatatatatatatattttcccactctttttctccgctttattcagattttggttcttctggtcctaatccgaaacagaaacaggggattcgcagttgtggagtagatctgagttgtgagcagtagattctccaaattttgcgggtaatgggtgggttcaccgctgaagatctgtcgaccatcggcggaatcgccaccgtgtcgcttctccattccttcattcccactcactggcttcctttctccattgtcggtcgcgctcagaaatggactctctccaccactctcatcgtcagtacgttacgttcctctctctctctctctctctctctctctctctaattgcgcaacttaggtcagcaacggtttttttcttcttttgttatgtttcttgctctgtgatgcgccaatcttgtcagggtttagggattgtgcttttcttctgtttggatgtgagtgagcagtgaaaggataataaatgttctcacaaatgaatgacttgagttctgtttaaagatgaaatctagtgatgcggttatgaatttttccatatcctcttgcaacctctcttctcgaataaatctatattatacttttgaaaacgttaggttcagaatcgttatatgaaatgaaactctacaaatttaaatcatttgatatttgacttacatgcttaaaagcactccaattatgctcacattctggctaactacaagtcaagctcaataattgcaagtttttgcaatgatttgttgtcctccgctactcaactgtagtgcaaaagttaattgcattaggatttgcatgaattgttatgtaattaacttttaaataggtttaaatacatttttcatcatgcaatttagcgtttttttcattttcgtcactgcaaaaaaaaattgtttcattccttgcaaaatgtgtttgttatgtttttcgtccttaaagtgatttatataacatgttttttaatgttcaaagcgctatataaaccggtttaagaatgaaaaataaaacaaacacattttacaagaagtaaaacatttttttttgtaaggacgaaaatgaaaaaagtgttaaattgcagggacgaaaaatgtatttaagtctttcaaatttgaactttcacttattaggagccattctagtcttttgccttgttgctactttcaatccagctttcttatttattgacagctcattttaaaatatgatttattcattttaacttaacttctcagtgcttttatcactccatgatcagctattcttggctagctataaaagaacttaggatttagaaaatgacttgttggatgcaatggatgttgaagttgacagtttgacactctcatcttcaaccaatgattgcgaaaatttctttgtacgtccttgttgccattgaaagcactctgaatttccttcttagccctatccactgtttcatatatgtaaccaacccattgcatctgcccttattcccatatgatgtctagtgcaaagactcagaagactgtgttcttggattttgtccataaagtttttttaaccttattcattttatttcatgtagctgcacttggagcaattttgcacgtaatatccacttcactgcttggtataacggcaattaccatggcaaacaccattgctggtgaagaaacagtgcataaggttgcttcacttttgcttgtatttctgggtggtagttatataattctgtttctgatgggaaagggtggccatagtcattcacacaaccaacccatggagaaaatggctgtagctggacttattctcgttcctgcattgtctccttgtgctacaacactcccggtctttcttgcagttggaaattcctcttccatgatggtgcttgccatcatagtactactattcaggtattaatcaatggcctatgattatttaaagtgatatgttatttgttggaaaaagtgtcagtgattatcaatattaaaaattctgatgttgaccttaacattgaataaagcaaaagctcccaagaaatcctatacttcatgatcattaaaatttgttttgattattgagaaactaatcaaatacattctattcaatgttgttaaaagtggaccaaagagtgaaactaggtagggaatagggagattccataacttttctgaagttgtttgaccatctactcagttttgagagtgaattataatcagacaagtgacgaattcatggttagaccagttggccatgtagtatgagttttaagttgtaaatcacatgaaacaatatcaaatttataaaacctttcaggaaatgtgattacagattaaaccaggttgagtattttagttggtccaaaggtgtttgaccctcaattatgttttgagactgaattataattggacaagtgtccaattaatggttaaactggttggactgcctagtctggtttctgtcaacaattactctatcacttgaacgttttcctacagggtatggaaatacatggaatattaagttgttttaacatgacatcatgtataccttttttcatgacaacttatgctaaggcttctaataagacatcatgtctgacaaacctctctttggtaccacaaactacttgaatttgagatgccatccaagctgaaaaaagatggttaacaattcagctagatcctttgactacatttttgaaattcaggttggttgatggaacatataggaatccttatttctgtcttgtatttgaattttgaatgctgttctgcactaaaaaatttacaatctttaaggccgagtttcttaatctgggttgatgctactctggtttagatgccaattaagtttgcaaataaatattgtttagatattcattactaaccaagcttacacatattgcatttacagcacaataactgtgatgacttcgctagtagcattgtcattttatggggccagtcagctgaagtttcactgggtggagcgatatgacaagcttcttgttggttcagtgctgtgtttagttggagtcttgaccttactttttcatgatcatgatcacgaagcagtttcgattggacagcactcacattcacataggaagattatttccttgtgagatatataaatgtttttgtaattacatgcttatgagcattgtcacggtattgtttttattttgtatcagaagggaaaaagaaaaaagaaaaacaaatgttgctgcttaggagaactgatcatcttggtctagttaaagtggttgtatactgagttttcaatgtgaaattaatgtgtttttggcataaaaaatactttgattaaaaattaaaaatgaatcaccaacaaattattctatttcttgaccttttctttagaaatttaattgggatgatttttttttcctaaaactttggtgtttttaaaaatttaaaagttgatatgataaattgagatgagtaattaattttaatttaaattgttttgaaaagagtagctagctattagtgtcctgtttcttttatgtattatgtaacattcctaattgttagcctctaaatgactttcacattataacaagtggtatttcattcaacttcttggtaagaatttttcagcacttaaaatcttatattatataatatgtttctcggaaatttttttagaatgttacatattgcataattattttaaggcaactacgtttgattgtagagattttgagtgataagttataaaatatatgtatttttttatataagtaatactaattaattttttaaaatcattattaacggtatagcttcataccttactgtctttgaatttttttcattctcgttgtggttttacatatacatgaatgtgtgagggtatgcaaaagagaaagaataattagatcattttattgatgaagaattgcatggtaatgtgtttatactccttttaaatattattaaataataaaattgtattatatttatgatagtatatgaagaaaaaattcttttctttatataaatgttacattaatattttttcaaatctagttgactttatttatatatatatatgtgtgtgtgtgtgtgtgttatatttaagtgaattagttatatttaaagtttttgtattgttcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatctctttatttgaatgcgtgtatgtgtgtgttaatttagataatttacatataaatactttgttgttttaaatttattacttcattatttgtgtgtgtgtttatgttaaaaataaacaaagtttgtattgattgtgacacaattcataactgagagcaacaccaaaaacaaataaaaagttacatttatgttttttctgtataataataatagagtgatttagtattactataggtatgatttaatttaatttaagtaattattaattacataaataataatttgtaaattgattcatgtagagattttttatgctttcaaaatcattctattaataaataaaaaaccattctgcatatgatttttaaaataattattaaagttttaacaatttttaattatatcacattatgattgaatcatcctctctcacacacataatacatattacactgattgaatcaaatatatatatatatatatatatatatatatatatatatatatgggtgtgtgtgtgaattgaatcaaaattagagattttctttaataggaagactaaactcccgaaaaaaaaaatagatggaaaaaattcgtgaataaaaaattaattaaagagacaaaaattacaatttttaataaatagtatctaagagtacaaatttttactaatattaccagcatgtcagtgttctcaaagtgttggccagagtatgttcgttgaatgacaccctcccttgaaggttttgtgaagatcaacacagatgacaactccagttttggattcattctccaataacattgcggccaatggattaaaggtttttgtggtatatataatatatgtgtagttgtacaactaacttgtatgatcaattgtatggatttccatgaatttcaccctcatcatgccctaattatctgctgcattcatgacttggcagccaaggactggaacattactttcaactttcaagcacatgcacctataaagaagtcaatcaatgtgctgcttcttcctcagcctcagttaattagcttcttcttctcttgctgctgctctaggcatctcatttgttatatagttattttgttcttcttgctgtctttatttttattcactgatgaaataattaatttgatttacaattctcttttttactatttattacatacttaaagaagtttaaattatctgaaatttaatatgtaagatttttaagataatatcacattatccagttgttaaattaattaatttacatatttataaaaataacttgaaaatggtaaaagatgagcacatcattgtttttttatttataattatccatttatttattttctaaaatttattcatttctcactataattatgatttattatgagagtcaattataattttcatacaaaagttttagcattaatgtaactataatagtagttttttattatttaaagtatgtattgttggattgatgaatttttttcatgtaaaaaaaaaaagttgatatatttttttttttacacatgatcacttatagttttagttatcggtaaagaatatgctgacactatgcttgaagaatatggtgacatttactgtggcccaccatatttaaaagacgaatttagaattagcgatgtagaaaaagtaaatcatcaattaaaggcatgacctaaaaaggtcatcaagccaagaaactaatcacatgtccacatttcctacactacacttttgtttttcttctcatgtgatgatgttccactttaccaccctaagcccagcttacctttttgcaaatgtttaatatcttataacttaatatatatgatatcattttaatattattcaattatagtattattttttttctaaattacacatttaatttttttatagctttatatatatatatatatatatatatatatatatatgaaaatagcatatgcactttttgttgagtacaagtgtgagttaaagtcccacatcggatagaaatagaaaagttgaacaccatataagtgaggagaagacccataaacctgagccttaaggttttgggtcaaagtgtggtgtctaattcacttatatggttgctcatgtaaatcttcccgatatttacccccctcgattttcccaacaagtggtatcagagccgatggttcgacttggtgatcagctcgtttgtggatccatggacatgagatcctttgtatcgaaagtcttcctggcgattgagtccatgcatgtgtagatcaggcagtgtgtcttgcaagtgttgttgcaacggtacaagatttagtttccgctcgagggggagtttgttgtttaccatgtggaagagactcacacttgagggggagattgttgagtacaagtgtgagttaaagtcccacatcgaatagaaatagaaaagttgaacaccatataagtgaggagaagacctataaacctgagccttaaggttttgggtcaaagtgcggtgtctaagttaaagtcccacatcggatagaaatagaaaagttgaacaccatataagtgaggagaagacccataaacctgagccttaaggttttgggtcaaagtgtggtgtctaattcactttcgtgtaaatctctccgatatttaccccctcgattttcccaacacttttttcaaggtacgtaaaatagtatatgaactagaagtgtaagaaatctttgtattataatttaatcacacacatggacttcgatgcttaaataattcaactataagatataagtgattgggatagaatgtctaatgatcttaacgtgtaactcatctttgatagttagattaagaaaaaataaagatgaagatattataattactcttgagtaattcttttcaaataatttagatttttatagatnnnnnnnnnnnnnnnnnnnnnnnnnnnnnnnnnnnnnnnnnnnnnnnnttttaaacaccctctctttaacctattaagaggccttttaaggataaaataatgagattagttaatatgagctaaaataaataattacttaaatgcgttaagcctaacaatttagtaaaattaacatgaggttcacacactactgatgccagaaagttgcctaaaaaaaagtcttacatcacttaaaaataatactattgataatttataatcatcctccactttaattcattgagatgttttttaaatataaaaatgtaaaattgaatattaaactttaatatactcaactttctttttttagaagagtaactcaacttaaagagaggtcacgaatatttgtttatgtaacaaactacattaaatttatgacttttgttattttgatttgtaatattatttttgtatttctattaattctttaatccttatatttgtgtttgagagagaagtttttctctgcataacttacttgattgagaatattaaacttcatcgaacacatttataagttttttgagattattaaccttcaactaacacatttttaactttgtttttaattaaagctttgtatgtttttgttcaatcttttaaaaacgaataaataaataaacctgcatcagtttagacactctaacacacacactaactatacttttatactaacagatatgtataatagaatattattgaacttcaaccaatccacgtgtaacttcatttttaattcaagcttcgcaatttttttttctcttcaatcttttaaacgaataaataaataaatgaacctgtaggaatttagacacttttttagatggaaaatgaaggatggaaaattagatgcctttgaaaagaaagctagtacaatttgctttcttgtgcattggtatattgaatattccaagcgcgtatttctcacacgctcaactttcgcagacactgggacccacgtggaggtgggcatcactgattcactgctgtgtttcttttgcatggaaccagctatgagtgaaaccattacattattttctctctcttctctgaacattcccaaatcccatttctgtcaatgattctcttacatgggtcttcgctgaaatccaagttcatattttgcagctttagtacctgccaaattttccatctttttccaaattccaattttctttattagcggttcactgtgatttttgctttttgggttccccatttgttcctgctacataaactgttttttgggtttgatcccacttttttttttttttggctaattactcaataaatatcctactttctattttggagctgggctatctatcccttccttgaaatttgtctcctttgtggtaaatttcgttgctttctgcatctccacgcactcactcaatgtgtttctcattgggttttgaacattgtcttttggatttcaacttcaactttctttttggatagtggatgcttttgttctctttgattgttttcgagtttgagctggttttcccacttcaattgttggtgctgtttgcagtggcttcactaacattgttttcctcaccatgttcctcagatcagatgcaatttttgtttgcttgtgtttccagatgaaagttgatggtgacattccaccagttctttagatgtcagtccattttcttaatgtgttgcaaatacaatcatgtttctgtgtacctaaaaaagatactagtgatctgcattttttcttgtggcaattgttgctaagtttgttatgttaagtcatttattgttcatttaatacatttgatgtttgatgaatttacagttagaacttcagtgaaggatttccataaaaggaaagccaatttgagccagatttggaacaatgggggcctcaagctccaaaatggaggatgataaggcactactgcagctatgtcgcgaaaggaagaagtttgtgaggcaagcacttgatgggcgttgctcattagcagctgctcatgtttcatacattcaatcactgaaaaatacaggaacagctctgagaaagtttacagaacctgaaggaccaattgagccttctttgtacactaatgcaacaccagaacaaccacttgctttaactgcaaggaccctctcattctcttcagcatctgtgtcacatcacatagatgcagctgaacatgaaaatttctctccaactccctcccctcctagttcttctagcaagttcagagcaaatcatatgaaacatagcactatttcttccaagaaggttgaggaaaaaccacctgtacctgttataggaatagtaacatcatcaggtactactacacagaataccagtgtaatgtctggaacagcagcatttgaagattcttctcttccagctggaactccacagtgggatttctttggtctctttcaccccattgaccatcaattttcttttcaagatgggaagggcatgcatcaagatatagggcatgctgatgacatacaaagactaagggaggaggagggaattcctgagttggaagacgaagaagagaaggctacatctcatggaagggaacactctagggactctgaagatgaatttgatgaagagcctgctacagaaactctagttcaaagatttgaaaatctaaatagatctaacagtcatgttcaagccaacgttgaacctgccacaactaagcctctcagagggcattcagcttctgaagttgaattagtgaatggagaaaaggggacatctgcttatttatctccattaaagacagcacctatgccagctttgcctccacctgaaacaaataaaccaacggagaaggaaagtcgtaatgaaaataaagtcacccctaagaatttcttttcaagcgtgagagatattgaattgctctttattaaagcttcagaatctggccaagaggttccaaagatgcttgaagcaaacaaagttcactttcgtccaatattccaaggaaaagaaagtaatctttctggctctcttcttttcttttcatctggctttgaaacagttatcatctgggaatattaaatattagtaggtcttaactttttagtgtaagtaaaatataatgatgagattttgagtgaatatcccccctccccctaatcatgctacttaagatacattacagatactcccagcatggatatccattaaattgcattatggtaaattttgttgatatccttggggtttgaaagaaaaattcaatttctgtttcaaagaagcttttggaagtttcttttcattgctgtgaaattaatttcaaaataaaatgctttaaaattttaaccagagaatttttatttgtaacagatggttctctggtgtcctcgtttttgaaggtatgtttctcatgtggggaggacccaagccaagttccagaaggtaatttgagtcatttcaactgtttatctttcatttttcccagacattactgaccttgttgggttgaaccaatcttcttgttagttctgaaaatgaaagtattctctaagtgtacacattttccctcagtaggactgtaggagtgatgcgaattgcaaatcctattattaaatatgactacagttagtgttgatcaagaaattgttgaacgtttgggattctgtggtgcagagaatctggagaatttgtttacttgagaagatgtatttggtgttatttgtttcctacttagtttaaaattcattttgagttactgcaacagagtaataagcattctctagtctgcctttaaaagtgaaactcatttcagaagataagattaatattagaccatctgagtaaatttcccgtctaattttttggtaatttagatacccatgcctgtgtttcggctgttttttgaattcaatgttaactattcaattcatcttcttagaacctgctcaaaactcggataagttcttaacttggcataggacggtgtcatctcgatcctcctcatcccgaaaccctttaggagcaaactcaattgacaatgctgaggaccatgcaaataatctctttgataattcttgtatgatctccggaagtcatgcatcaaccttggataggctatatgcttgggaaaggaaactctatgatgaagtgaaggtacgatgtatttcttatcaacatatttgtcaacctgtattttctgtatgttactttttgataataaaatgttgcacaactcttgtattggattcggatcttagactaaaccctgaagttttatgtttacaattatatttttttaataaattggtacatgtaatagaatatggctatttctctgtctgtttgctaatatcattgttcacttctgcgagtaggctagtgagattgtcagaaaggaatatgacatgaagtgtaaattcttaaggcaactggaatcaaaaggagaaaaggcctctacagttgataaaactcgtgctaaagtcaaggatctgcactcaagaatcagagttgcaattcataggataaactctatatcaaagaggattgcggagatacgagacaaagagcttcaaccacaacttgaggagttgattgaagggtatgctcctgtcagttttgctatttttatgaagtatctatttcatgccaatgtgtactgccttgataataatacatatacaagcatgggataaaaggtgcatcaagaagtgcaatcaggaaattccataagaagaaagtttatttatcaggaagtttatttttggaacaacttgctaaaattgattaagttctttatttggtaaaagttttccactgaaggttataaatttattgaacaacgaagtaatagtcaataataaaaaagctcagttgctgctgaaatttattgttttgcttttgttctataccaaccttgctgaaatgtattgtttctgcatctgaaacctagagttttctaccagaagagtctaggtatcaaaaaccttttgtctaaattaggagtaacattatcgtcaaatgcaattgacagttttccaaattatagtattaagagttaacttttagtaattgattatgcaagattgatggctttctattgtgtggctcactgatgttgtgcgatcaacctttgaatgctattttttgatcttggattagtaagcaacatatgttttcatagtcagagggatggatggttaacacatcaacttatgttaattgatatgatcttctagcttttgtatttcatctgtttctgttatactttgatgtcaggttgaatcggatgtgggaaatgatgcatgaatgccacaaacttcagtttcagataatgtcggcagcatataacaacagccatgctagaatcaccatgcattcagaattacgtagacagattacttcctatcttgaaaatgaactccaacttctatcatcaagctttaccaagtggattggagctcagaaattctatctggaggctataaatggatggcttcacaaatgtgttcgtcatgaagaaaaatccaagagaaaaaggaggcatcaatctgaccttagctattatgatcctccaatatatgtcacctgtgctgtctggttgaataaacttagtgccttacctgtaaaggatgttgccgattcgattaagagtttggcaacggatactgcccagttcttaccacaccaagacaagaaccaaggaaaaggtgctcatcctcatatgtcaacatggaagcctgatattggtggcgaatcagcagatggtttattgagagatgacacatcagaggactgggttacaggtcttgatcaatttcgacgaagcttgattcgatttcttagtcaattaaataatttgtctggttgttctgtcaaaatgtacacagaacttcgacaagccattcaggaagtcaaaaattaccagcgtttgaattctcagtctcaaaatgatcatttgaattctcagtctcaagatggtcatccgaattccgaatctcaaagttgatccatcagagttacaatctcaagtggtttaggctgaaaacaaacatccacacgataagagaattgcaatgaaacattgtggaattgcagaaatatagcattgtgttgagcatacaagtccacaggatggagcatttgtacatggcaagatgtaataaagtcattacggattgccacacttatttgttcatttagtcccaagaatagaagggatctgatagattgcactagagagattatgagtgcatgattaaggactcagtaagagctgtaagtactaggttctgatggtgaagaaatttgggtgcaattattttgctaataaagggtttgtaccagtacttgtacttctccttgattttcttagcttgtgtcattttttcatttacgttatgtgtatataattattgattaataatattatttgaattttataaaggaacactcaaatggctgagagctcgtttagttaggaagactgaatgtctaattttagtattattggaccaatttttatagttttaaaaacaagtgattttgatttaaaataatctagtgattttttttatagagatttttttataaaaaaaaaaggcagaagcagttgattttatgagaagctatttaagatagcttctgattttaacgatattttagattatgtttggcttctgattatttattttttaaaataaaacaaatgcatgaaaaattaaagtagtgattttttttttaaaagaaaaaactgtaacgaattattatttgggttggggaagtacccacttattaccagaccaggctagccatcagataaaaggcttcaaggtaaaaaaaaataaaaactaaaatagggtttgtgttaagggataacatgacaagaaatcattaaaacaagttcaataccgatgaataatgtcttaaaaagtgtccagagtattttactcccctaaccgtggctgctttcaagacctttaaatcttcttttaggcacaaaaatattaaaataatcattaaaagaataacagcctctatcactgccttttatacaacaattttcggtagcaaaatgtttgcagcttccatgatattactaattactaatattacagctcggaataataattttttattataattataagaaattaaattatgaatttatatatagtgcttgggacgggaattgcgtccccaacaccgcttttataaaagagagaaaattccaaactcaaattcaattgtcatgtctgttaaccttgagaactaaaataaattataaaataccaaaacaagaaaacaaatcttaataaaactaaaacaaaaataactctatattataaatatatataaaaaaaaatattctagctatatatgaaaagaagaaccgtggcctcttgcaccgtacttggaattattccttatccaaagagtagatcttttccccactcatagattttgaccgattagtaaaaacaaataagagtaattagtaattaaatgtagtttttctaaattgaataaaggtaggaccgtatgaggaggatcctagtccaataaaagtatagtaaatgattttagttattgatgaaaaattaatagttggttttttttactaaatagttggtgttttaatataaaaatgattttttgttatacatataaataaaatgaaaatgcaaacttgaaagagaaaagtgagtgagtgagtcaaaacgttattctgttctctgaatatgattgtaaaataaacaaaagatttatatgcgttaaaatttaatagtcacgtggtttacggatattactaatatatgaagggtgttagacactggctaaaatatttcatatataaaaatctaatctaattaatattgtattaaaaaagaaagaataaaaattactattttttttcaaaacaattattaaatccaatttgatttttaaaaaatcttattatttttattattaaactagtgtatatttatttgtttagagattaattataaatttaaaaataaaattaattaaaagattaaaattataatttatagaactagtataatttatagtctagtatatatatatatatatatatatataaagaagaaccaaagcctcttgcacctaatacttgaaagggtattgttaatcagtgttccaaaaataatagttaaggaattaaaaaaaattcaatatgtaaattataaaaaaaacacaagaaaaaatataaaaaaaatgcaattttatgtcataaaaaaaattactctttatttcttaactagtgtccttatgacacttattatcatatgccaattagctttgacttatgcaaatatgtaattaattatacacgcgtagccgttgtggaaggaaagaactttgcaatgacttctaattcccagcctgctacaatgacagcatggaaacagtaaatgctgaaaattttgatggataaagatgcaccggaaattatggtgggatacattaacaatatgttgttaaaaaatttaatactattttattaaaaaaatcagttttttacatagaaattttcattttaatgtcattaaaaaaaatacagttttaaaaactatatataagtgtactatttacatttacatggggcatcgaaccataaggaatgtgtcggtttggtacaagagcttccttccaagtataatccaccatcgcccccaaaaaaccaaaaagaaaaaagaaatacccaaccctctctttgtgcaacatatatacaaatcttacaaattgactaagcaaagagtagaccttttccccactcatagattttgaccgattagtaaaaacaatttaagagtggttagtaattacacgtagttcttctagagtgaacaaagacgacttctttttttaagaaagtgaataaaggtatgagaaggatcagttcaataaaggtaaagtaaatactgttctgaagataattacttatattttttaattaaatgattcatgatttaaatcttgattaattcttgatataaaataaattatactgaaagaaaaatatctatttatataagtttaaaaaaatgagaattaatgttctaaaaacatttattaataacatctttattttattctttaaagttaacctttcacttgaaaaagaatcgggtcctataatttatggataccgacttgtataccgctacaagtttatgacattttggctttggttgtaccgtcacattaactaaaattaattagaaatagaaattaccttggttttctggatcacccttgatacaagcatctaagaaaaaatgtaaagaacgaaaatagttgatacttgcatgttgaaagatcaatcagccaaaataaccatctaaaaataattcattaatgtcattttttgtatgtaaggctatatatatggaaattcatatcagaacaaaagagaaaataataatcatctcttttactcaaacgtgatagaaactagataaacagttaaatgcaataaaagaaagaaagaaaatttcgagagagaaaaaagtcaggttacttttccctttaattgaatctaatcgaatagaattacctttttggaagaaaaaaatattaaaaatacgaatgcatatgacttatgaataaaaaatacttcaatttttcattaaaaaaatgtatattaccattttttgttcttttcgaatcataaataactgttattagcaagtagcatggttgataacctactctactttgaaaattggttaagaaaagaaaattgtcacataaaaaattagaaagaaaacaaacaaaatatgtgatgtttatattgaatagaatagagtaacaacatattatatagcacattcttactagcacaatgtttactatgtagtattaattaaaacttattagaaattacaaaattatgaataagactcacataattatattatttttaataacttttttagtcaataataaaaagtttattgtctttttacagcataaaaaatttattgttagtaataaactatttgataaattttattcataacatgttaatgttttggtaaattttattaaataaaagatattaaaaaatgtgttagaaaatacatttccaaccaccatcttgcttgaaacaaggttttatacagtagttgtttcatttggtgggtacgaccaagatgcggtttcttatttagagaccaccaaaccaatcaacaagaattcacattcaggaatgaacgatgaaattacttactttattattcaataaaaatcatatgcacaaaaccaaatcaaatcctaagatacatggcgcacgcgtatcagtaaatgtgctacaatgtaacattaatgtatacgaaaatttgtataatctcgaatatttcggtcttatctataaacgaagaaaaaaaaaaccctttgctctcagcggcttttttcaccaaagatccacgccataattacaacgtttagaaacaattttggcctgcgccgttaactcattcaccgtcacatcacagttcaccttaacggtaatcttccacgtcttaacggaccccacttttattttcaccggtgccctaatcctaacggtcaacggcactctccgtttggtctgcgcctccagcaacgcgcttaggtcctcgctcctcaggtcgattccgtcaccccttaacgccgtcccaaacaccgtcacgttgtttgacggctggtaaaacgccggcagagcgccgttacacagcctcgcgtccttataaaacacgccggcggagctatccttcaagtaatggatcccgatcttgtcgttagggttatcggccttgacggtgacgttgaactccggtgagatcgcggccgcggaggacggtgaggtgaggttaattcctctgacggcgatgttttcgatggagtatttcggcgcctcgggacggaaaacgaggtagatgacgccggcggcgatggcgaggagcacgacgagaatgaagaggattccgatgagccagcagaagcagcagcagcatcggctccggtggtgtttacggcgagcgtattggtcgtagcggcgagcgttctccggcggagggacgcggtagacttggtccttcgggatcttgatgacgtaggttccaggcggaggcactggcttctccgatgacggtggagacggcggtttcggaacgacggaggagtcttgaggcgatgccggttgtgaatcggcggaaacggaaggcgagtggctggggtgaactcggtcagccattgagtgagtcagtaacgagtgaagaagctatctgaaaattgaagtgaaatgaaattgtaaaattcgaagctagaagagtgagtgaatcacaacgttattctattcattttatataagaagcaaacggcttacgcgttggaatgtaatagtcacgcggtttaagaattctactaatatattttaggcagttagcatttgtcatatatgaaaatttaatctaaattactattggataataaaaaaagaatagatattaataatattttatttcaaacaattagtaagtcaaatttgattttttcttttaagaaaataatcttgtaattatttttatttgtttagatattaattaaaagtttaaaaataaagttaactaaaagattaaatttataatttataatgctagtataatttttaaaaaatattaagggacttttcaaaattaaattaagtcaaagttttttattggtaacttcaaaaagcttttttattagatggtagtagtcaaaaagaatacaccctatcaacaaatgctgcattgcacgttggaatcattgttgtttgttagtaattaattatatatgactcacacttacccatatggaacatttattaaatctcccaaaattaattaattagaactttgagccgtgactatgaaattagttaggatcatagatagaagagataaaacttaaaagacaacgaaactatcaaaacaagtgcatgaaaaccataagaaacgattataacttctaagtgattatttgaagaaggatatgatactttaatatataaatataaattaggcaaatgttaaatagtgaaactgatttagaaattaaaaaggaaaatttttattattaaaatacacaaaattaaaattaaattgtttataatttctacaatattttttaaattaatatactaaagatactgattattaaaatcctatacattaatataataactaatacacaaatgagggaaaatggagtacagttcaatgtgggatggcaagtttagaaaaaaaacacacgaaagcaaagaaaggaaaatgaatgggtcaaaggagtgtttggatgcaccatttggaattatggattggcgtgtatctaattttgatgtaaacacacggtatgctaattgttgccgattcgttttgtctacgagttagttggcgctttgccacacgcggttttgtttcttatggactggcctcaacccttcaatgctttcctttttgtataagcatttgtctttgcaccaaattagtacgctttatgaatgtaatattttttcgtttataaaatggatatccaattaatggcttttacctaatatttttttttcctttaacttgaaatggtctcatgggtcaatacttaacaggaaaaatatacaacttgctcttctaaaagtgtttgttgcaagaaatttgtttgcttttctgcttcttgtgcaaccgacaaagttttatcaaaacttgtataataattaatttgattataattaaaaaataatcatttacatcataattaattcaattactaataaaaattataacttgtatattaaataaactcaaataaactccaattaaaaagttaatttgtattataattaatttgattatagtaaaatattttttttattgtaactaatttgatttcaattaaaaaggtaatttgtatgataattagttcaatattaaaaatggtaactttacaaaaaaaaacttgtattttgagttaattagaaaaagaaaatttgtttctattatgtagtggattgataagagtgggtcaatctataatatacaatatttatttgtaaaaaattaacacattaccaatttatttttgttgagtatttgtttcacatatataacacaaactaaacaagtttttgtggtatatatgttccacgtacattataaaaataagattaaaatatattttttatccatataaatatcgaaataattaaaatttgtttttgaaaaattttgaatatgtttttcatcctcacaaaatataaatatatgatattttggcttggaaatggaattgggagatctaatcttaggtgtcaatgtcaagtcctcgtaagtgagtcaacatgtcaactgaaacttatcatgtgtcaattagaacttggtgtgttgatccactgataaggacctgacattgacatgtagaataagatctcctgaatttagttctgaaccaaaatatcacacatttatattttgcgaaaaaaaaaacatattcaaaattttataggaacgaattttgaacatttcatgttaatagaaacaaaaaacatactttaacctaaaaacaaattttcgttagagtatacaatgaaaagttgtttctatcaacagtatttgtgaaaaaatacaaaaacttgggggtgtagacttaggattaggattgagaataacaggggccgtgattgaatgcttaatcttagtgttcgcaagcacaccggaccactattagcacatgttattcccacactcattttcgtcattaccacacctccatcacaaatatttactccttacatcttaaactaaatgtcatgctaaattataattattatacacagacaaaaaaaaagttaattaatcaaataataataattttacaaaattaaccttattaagtacttcctcctttgcaaaatatgtaccacatttggaaaaaaaaattgtatcaaaacaagtgtcactttaagttttgaatgtaatattaattattttttcactaatactcataatactactctttttcatctattaaatataaattagttttgtaaaattattttattttattttttcatctatttattaatttttcttggttaatttgtttaaaacaacctaggaaagagaatgatattagttttatgttgaaaaactaaagtaacacttattaagggtataggtaaaaaaataatattacattgaaaaacaatttatattacattgaaaactaaagtaatataatacttattttgcgatattttttattcaaatatgacacttattttgggataaagagaatatttattagaaaatttaattatgatataatttatggtaaatattaactagtaccctaaggatattggttaagaaacttaaagtaaaaatatttttattagaagtcgaaaaattgagtagttcataatcttttacgcttttttatgatttacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgatttacataataaatattttttattttagtttcttaattaatgtactaatgagattggttagcaagacccatgatttatatattaaaagctatttatttattataaattttaattatataaaaagtaaatattttttaccttatacactgtacatactaaacactagtttataatatttaaaaatggtgaaaataataaataataatctttaaataatttctataaaataacagttaaaattatgaaaaaattaaataaactatataataaaatccaaaccaattagaatctcaattattaattttctaattaataattattattgcatgaacatgtaaattaattgacacgagattactcttagcttaatcaaaaaaatttatcacctatagtaatttcacaagactcaaatagaattacttctcattgaggatacgtgtcatctatatcaaaaagtaaattttcttccttacataggaacaaatccaaattaccaatgaaaagtcaactaaatcctaactatgcctgccattacaatttgccaaatataaatccttcttgcacctatataacaccacatccaccattggtctcatcacaaagaggggagaatcacaactacatgcagaaggaaaaaattaaaaaaaataaatcatggaagctcaagctctactcgccctcactcgtctaagcatctatgcctcaggcatgcaagcacattctctttcccctctctttctttatcatttgctattatataccaattatatatacaactagatcacaaaatcttgttttattcttcaccaacaaattgttgtatacacatacatgttacatatcacaggtgcacacagtcaaattcacattcacaaacaattgtgcattcacagtgtggcctggaaccttaactgctgcaggaaaaccacagttatcatcaacaggctttgaacttccatccaagtcttcattttccttggatgccccagatgggtggtctggtagattttggggaagaactcactgctccaaggacccttcagggaaattcacatgtgggagtgcagattgtgggtctggtgaaatccatgcaatggtgcaggtgcaactccaccagcatctctgatggaactcagactagcctcaggtacacgttctctaacctttttttttaatctgtggcaatcgaagacagatatcgggggtttaacaactcacacactcagttcaaccgagttaaacctctccgtcgttctctaacctttctatgactattattatttgttatgaacatgctataattgatcagcatcatttgttattaattttccatcatcagatgctagtggccaagatttctatgacacaagcctcgttgatgggcttaatttgcctctctcattgactccacaaggggttctgggttgtgcaacactactagttgcccttctgatgtgaatgcagcatgtccaccaggtttggctgtgaaaagtgattatggaagtgtcactgcttgcaagagtgcatgcatggccttcaacatgccacagtattgttgcactggtgattttggtagccatcagagttgcaagcatagtgagtattcgaaagtgttcaaggggaagtgtccttgatcagtcttatagctatgcttttgatgataaaaccagcactttccaatgttctgggaggcctgactatgtcatcactttttgtccatgattctataaattaattagctagttagttctacctgcttttagtataaggaagtgttcagataatcagatgtgtttatatatgacttgagagaaattgcaaattcaaaaggctaaacaattgtaccaaaagtatgcaaatacttatgaagattaagaaaaataatatgtttagttaacaataaatttatcttaaattcgtaactttctagaattatccttgtaattcatatttatcttttctaatagttgtcaatacattatcaatctctcttttgtaaattaggggtatttgtagtctaaaataattaatacaagaaatattataaattaaatcttataaaaagaaacaagcatcattttaaatttggatattataaataggaacaaaagaagtactaaaatattaaaatttatgttgtttaattacttttttagtttggagcatataatttgttttaattacttttaatatcacaaaaggaaaaatgataaataaaatatattttttgtcttcgtaaaaattgataatgtatatttttttgtccttgcaaaaattttaatctatttttcattttttaaaaattgaaatattttttttttcttagagtaagttgggttgtgtctgaatctataactatgttacattatttatgcgtataaccgaaaaatataatgtttttacatcagatatgtataattacatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataaatattttttaaatgtgtaaattatatattaaatttatgataaataatatatattttgatataattattttaaatattgaaaattattataaaaatattataagttcaattttaaaataaagatgataatgataaattgaaaaaataagcaactaaaaaaatcaagatatatataaaaataagatgataataatttgagatggtcaattaaaatttaagtatatttaaaaggaataaaaattaaaactaaattaaatagtcaatatatgtaagattgggatatatacgagacagagagataataattcttaaaaacactttcatctaagaaaaatcctctcattgaagaattactcttcaaaatactcattctaaatgagaattcaaatttataatgaatggaatgagtatactgtaatctttttacatcattaaaattttcctaattcaagaaagttaaattcccaacccccataggaacaattttataacaatatacgtcaaaaaaattcctggaaaacaatattttgaggttcttttaaaattatatatcaagcatgataaactaacgtccctaaacttcagattgctggaaactaaaaatttccaataccaatcacctaccaaggttgttacaatgtacatgtaccaacctgtttaaatcaatttcaaagcatgaaaggaagataaataggcaataaaagatgcaatgggtttggatcatagcattattccattgattgcagcgaaggcaaaaagaacgtcaagcaatatcaattattacactgaacaatactgcaaaattcatgaatatacaacctgcccattgaagggttgaaaagaatgaatgtcctttgacaaagaatttcatttcatatcctgacttgttaatttgttataatgcctgtggagagctgtcatcaagggaccaaaattcaacaaacttgaaaagaaacttaaacaaaaaacaactatagatgatgatgatgttagtggttaaggctatatgatatgatcagcaactctaccttattgttgagagatcaccaaagacggttttcatgtcaggcctatcagatgctggaaggatgcatctaagagccacctttagcatttcatcaagaattttagattgtctttccccattgtgcttgtccattatagacctatcaaagcactggtttgaacggtcttgttcggctaagaacctcacccagtcagtgaggtcaaccacccctggaatcccagaaactatttctccagaatttcttcctgttaggagctctaacaagaccactccaaatgcatagacatcacttgtcagggaagggcatggtttgcttgatctagaaaactcaggaggtcgataaccaagtgcgccagcattcagaacttgctcagcagtaccagcagcagtgagtattctgtgcaggctgtagtcagtgaggaggacatttctgttgggagtttctagcaaaatgtttgtggatttgagatttccatgaggtatggctttctcatcgtgtaagaaatgcagacatcgcgccacctctacagccaccctgagcctttcatcaacagacaaaggatggagatttcttttatctgtctctgcagaaaaatttgaaacaactaaataaaacagaagtattacaatttacaaccaaaagtctaggtgttatgctgcaatcaaacatgcatgaggccataatcttaccatggagatataagtccaaagattgtgcattcatataatttgatataatcagtttctcatgttcctttggccccaagtagtaaccttgaacagaaaccagatttggatgcttgatagtcccaagtttctttatttcccttgccaactccttttttcctttagttattccttctcttaaccatttgacagccaattcatgaccagagtcaagtgtagctttgtagagtgttccatgacagctcctgccaattacttctgctggagcacatgaaagttcttccgcagttagcaccaaggatccatcaaatacatgcaagtctccaaccagtttatctggagaggagactttgagggaaccaggattctcaaactgatagctttttgaagatgaaggatttgaaggtgacaaaatagacattggggtagatgttccttcctcgttcttacctaattcaaaagggccaggatctattggcttctttcccactggatgaatgtttattgcatcatcagaagaccccctttgagcaggtggtaatgtttccaaatttctataaggtgcctctgtatttgaggtgaaagtactctcttgggtggtgctccttgcttcattttgtttagaagtcctttctttttcatgatggaccttataataaattattatagccacaaaagccatcacaaaaccaccagcaaccaaacatgtaatcagggcaatcctagttgcagactttttatgtaaccgatgttccctcaaacctaggttggaagtatcttttggtgatgattgtgaacgtggaaataccagcatagtatttcctggatgaaatgctgagtcaggaaactgctttaagctttctggcacaacaccagaaagattattaaaggacacattcaatactctcaactcatctggaaggtcatcaggaatagtaccttccaattggttattgcatagattgagatatgacaaattgtgaagcctactcatatttgaaggaagagtcccactcaagttgttgtgtgaaagatcaagaaacaccagactaaaattttcagcagaaactaatggattatttggaggttgaaactgaataggaattgatccagaaaatttattgttggagagattaagattaatcaatttggttgaggtgaaaaagcttggtaggacgaacccagaaagctggttgaggctaagatcaatctcttctagttctggatatgttcccaaaattggtgggagaaatccctccaatgagttattggataccttaagtgcagttaaccttaaaaattgagaagtttcatttggtagcattcctcccaatgagttggcacttagctgaacaacttccacatagttaccccaataccggatccttgagaaattacctgatagtgtgttgttactcaaatctatgatggaacagtggcctaccctgagaggtaaggggccatacaacttgtttgaagataaattaagcttccgcagagtcaccgaggtaataattccaatgggacctacaaagaaagtttaaattgtaaaagaggaaaaggggtaagcagaaactcattgaataacactttgaactcatgtcatgtgtgattttatgatattatgactaaaattgatgaataagtgaatgctaaacaattgggtatagacaaagggaacaaagtataccaagatttctacgtgcagaatagattgtttgtcacatgtagcatacttttggacagattttggaattacttcccagttcccacaatgtttgtacatagaaaactaaatggcttctataaggattaacggatgaatacataaaaatggtataccctggacaccaacttcattgcggatataggttaccacataagaattttctgcaaagatctaaaggtcggctaatagttgcatacctgattgtatactatccaaaagatcccctcaagagggtttaacatcaactacttttcttccttttcaaattttgcatctcaaactgactccataaatcaatatattggactgatgctgattatatgcaaccaaaatactaacgttaagtttttaatatactgtgtattttatatggttacattagttttttagtcccctaatttatcttttagattcaatttagtcttttaattttttctaggttcaatttggttctctaattttttaaattaattcaatttgatccttcagtctaaattgtaagaaatcacactttgtgacggttcaaaaccaccacaaaatgcacattttccaaaaaaaaatgaaatggttttaaaaaattagaagaccaaattgaacaaaaaaaaaaactagaggaccaaattgaatcaattttaaaaattagaggaccaaattgaacctaaataataaattagaggactaaaaaactaatttaatctattttataattaatgcaggcttccttagtacttatttggcatacagaattatgtttgaagtacaatttatccatcaataggttgaaccatggaacagaaacttcaaattggacaaatatgaaattttctttaatttgagttctccactatttcatatacaggtaagaaatttatgaaataatttgtatttcagccaatattgatcactaatagactttcatttcagtttggtcaccatactttcctctacaatctttgttactagaaatgattgagggtgtgaaaagtatttatttattccacagaagaaaattccccaaagggtttatctaaaataactaaaatagcagaacagtgcatcagaaagaaagttgcagtttcatatttcagcaaccaaacagcagcttgatatgggtttttggccgtagtttttcatagctaaaacttcatttatgaaggttagcagaacggacagcaacaaatggggagtagactagcaatttcaattgcattttgagtttagatacatttatatagaaaatggataagttttaactttgaagaaagaatatcattacaattttcacagaaaacatagaaggtaccttcaagcttgttttgactaagatccagttcagacaacatcattgaactttccttcaatagagcttcgggcagtaaaccagtcaactggttgcatgcaaggcgaagaatccgaagggataccacaaacgtgaaggaaggtatattaccctctaactgattattactagcatcaaagacctctaaattgtcaaggtatggcataccatcatgagcaaataactcaccactcaaggaattatggctaatatttaaatactgaattgaagagagaaatgactcatctgcaagtcccaaatccggtgtaccagaaaacctgttgctgcttaagtcaatatatagcacactgcccatctgataaaatatatgcataatatccccagagaacttattcatgtgcaaatctaaatacttcaactgctcaagtttgtgaaactcaataggaagagtacctccaagttcatttgaagaaagattcagatatattaacttgcgcaactgagtgaagttagagagtaacgggccattaaacttgttgagggacaaatcaacatattcaagtgattcaattgtagcaatatgtaagagatctcctgtgaactggttgttcacagcggacaaattgcgaagcattgtaaggccactaattgcaagcaaattaaactcaccaaccaaaccagcattgtccagagtgattgatataacactgccttcactacacactatcccatgccagttcttaggacaaccatcggaatctgaagacctggaatcccaagaattaactactaatccagaacggtcattctgaatactcttcttgaattcaaggagtgaatcaatatctgaattccccaatgcaatagccaccaacaacaatagcatgaaccagatagcctgcatgcctttcctagtagctcctaatccaagcatcaaccaaatgcaaatgattatatgagggaaagcaacacaatggaagtgagagcaaaggggcaagccgcaagtgtacaacaaaaaattaaaggcaagagagtaattttagagcatgttattcaaacaatgatgcattcgtacctcttaattcacaagaagtaaagttgagtaatgaagcatatacgcgtagcaactgaagtaacaatgctaaccaaagcaagtagaagaacaaattcagaaggaacaagggaaccccagtaagtttctgctgttagaaaacgaatggttctgagaagatgaggtcataaatctgaacaaggggctgagtagggtggaatgcagtgtggcaagcaaatgattaggggaaagttttgattttgagagaagactagtagcacaatagtgtcatagagcaagaagactgaggagacattaactgagaacatggtaggtaggttgctgttttatcatgtcatgattaacaaaagcatatacagattaaattcatctaaattattttatcgataatatcgataatcatatagcagaatgatgtgttgatcctatttttcttttttatagcatctcttttaattattatctctttttcttcacattttctttccttatatatatcttaagtactatataatatattaacttaaaaacaggtgctacatgtgctacataatatatcacttcacttcttatatcacacttttcaataaatattaatatttttttgacagaaactatttcgttctaatatggtaaacaaattaaatatatcacttaactaacattatgaaagtgaattcagaaagaaagaaaaatagaagagaaaagtgatgtttacttgatgtaaaagaactcctataatttttaagggaaaaaagaaaaggtttgtgagagagacttttcaagacgacgtcactggattgtccccagatacaaagcaactgtatatgacctcgttggcagcacctttgactttaagggttagtttggttctgcctccgaaccttcgcattaatgcaaaaattcatctaaaattttatagataacgcataagtaatttttagttgtgcgacacaagtccaaacacacggaaacttttatttaaccacaacttcctattttttactgtcttccatttctaaggatccaatgcaaaagcgcgtcctgtcattttcaaccttaagcatttagtgtgtatttaatttgacattgatgaattgattataaatttataattgatccttaatttatttaatgtaactttaaataatttttacattaaatttaaaattttatattaaattttactcctaacttaattttataataaaatatttaaatatattatctcacttcaaaatcaattctacaaaatcatgttaatgtttatccaaacaactcttaattttatgaatctaaatgaatgaattgagatattagtaaaatttttaatatgtttgtttaaataaataaataattaaaacttgagattgaattaaaaaatatgtttaatctaaaaatttcaagagaaacttaaaaaaacctaggtgaaacattactttactttctgagacaataagtaataaataattattcaaataatttcagagaaatattaattgaagttatatttggataaactctttcataagtatttatacgttgaagactctctaaggatgtttgggagttgggatccttaattgagaatgtagaagtattgtttctcataatcaaatatttgttgtaggttttgtgaagagaaaaactaataaatttgttcatgagttagcaagagtaaatgagtgactctatctttatctagctatacttttaattgtataattcctttagttgaacatttactttataatgaaataatataaatatgttttagtaaaaaaaattataaattgaaaatgaattaagtttatcgcataaactaaaattaagttatatatatttttataaatgttcttttcatgagcaatctatctctcattggaccatacacatacgagcattcatgaaaagatcttgaaaagatgcctaattaaatgctataaacattattgccagtgaagcaacaacttcaagaactgaagaatgttgatcatgagctcccactcgatgtatccaagactgaagaggagcaggacaaggtgaattttttgacattagaacaggaccttgaagaggcgtgacttctttcaaggttaagattagttattcattacaatcattagattttaagaaaattaattatgaggatgagaagtaactcttgaagtaagttaatctctcttcatctctctctatatatttatcatgtaactgaacatgtgtaatactctttttcagtctccagcagattaagattggaggatttgttgaaagtttgtggaaaaggcaatgcagaaaggtgatcacacttgacctaaacttggtcaatcttttgtaccactctagctttaatgactttagagaaaactatttgattaagccttcccctaaatttgtgtgtatgtgcagggtatgggatgaactttgcaggaccaaatatggagagagctcctctgggaaaggagaaagctccaattccaaaactgaaccttttgggactggatagagctcctagcatcaatctgagtcatctgggaacacaagttataaactggaatacaagtatcttttgaattaaataaaaattatggcaagtaattagtaattactacaatgatatatagttagagtagtttgaaacaaacttgtcatactgctgcttctattgataattttttatattaaagaacaagctgtactacaatggttatttttacaagaatggatattcttaaggattcaattaatagctaaagaaatatgattatatgattagtgcgggaatgaattctctacaattttttgtcccgttgtcccagcaacgagttattcaaccttatggataaattcatttattatatcactattttagtacttatttttgtttttggtagatctaagttgattcatggcttcgaataatctccgaataccatgtagcctacaatggcaatgagtataaaggctaatgtgcttctgacaaagcaaactagaaaaacatggggtaaacaatgagtgttatttttactaaatgaaactaatggcgatggatccatagctaaatgccaaaatgtgtttctgacaaagtaaactagaaaaacctagaagtaaggataacaagctagcaagtttcaataacttctgttgcatcttttggatttgaagtatcaattagtcattttttcaagcctttctaacaatcaaataacaaggatttaattcttgaataaattgcagttataagaacaactttccttggaaaactgatatcaaagtcatcttttaaagattaatgttctttgtacatgttccaggacattcaattacaacacatggtattcctttttgagccaagtataaggtagtttgttttaaacattaagcaaggataaggataggtattgtgtgtaattcgaaaaaatctcaaaggtgttaacataatttgctctttttcttttttgataaaaattaacaggtaaataatatatacggggtccttatacgaggtcctttttctccaaaatacatttgatcttaaaagcaaacgaataatactttgtctataatagtttaactgagacatattcggagtcatatttctctagcacgaagatatccaattggaatcgagaatagattcacactttgttacaacactttcaacacattcgaaagctactcaaaccactatcatatctcaattcgttcatagacacaactcaatgaagagcatgacaaaaatggacctttttttcaagaattttgattttcctttatcgactccttcaaagagaacaaggatttttacgagaatgtttagagttgaattttaaagaggaaaataatagaagcaaaaaaactattttgtaataaatagtctgaattaatgttttttcaaaacaaaaataaaataataaatcaaaatagatttattattttaattttccttttattttataatattatatagttctcgtagtttaaaaatgaaaaatatttgttttgggccaaccaatgtctaaagtgctccaaaattaacatgtaatatcggcccaataagtaaatagtgtagtagtgtctcaaaagtaatgcaatgattaccctctctgccttaacgtgattccatcaccttgggcatgcaaagcacttttagtctcttcctttttgattagaaatagcttgatgctctgtttggttctgaggagaaaaataaactagataaaaaataaaataaagataattaaagaaaagaaaaatagaacagtagactgataaattgtttagtttaagagaaacatctgagaaagagaattaaataaaaaaagtaaaattctttgattaaaagtagcatcttataggcccaaaatggcaaaatctacacgtgagttggctaaaaaaaaatgttatattgttttgcattaagagcacaaaagtaagaaatactttgtccacttaaagagaaagttgtgagactcgttgaattttaaagttcactccataatttttttgctatcaaatgtcaaatctcaactccatcgtaactttgatgtgtcatgttgtaaagagaataattccttccataacatatggatgtaatttgatattgcaaacatacattataatcaactcctcaattgcttaattcaattagaaacttcaatgttttttggtgacaaatatgattgatgcaaattatccaaatcttatcactaggtcagtcaatcctatggctagaaactagaaattttagtcaagccatcaattgataatttgctatatatttgtttgatttgttttcacgtttccttttcccactgtgatgcactacctaattctaaatttgaagtttttaaccacaatgccactctcatccacgaaaaaaaataaaaactgggcttgtaatcttcatcttactgggcctgggcccagttcccaattcttgatcgaaacactcacatcatcaatttccagtcacacaagaaaagagggaacactatttttttcttcttttattccttcccttcttaccatgatttggacatatcctgtattatttaatattatatcatttttggtattttattagtatccttttgactacgacgttgatggtaatatgccatccgtgatagttaacagtggattaatgatagagacgtgactaaatgtgctagttttgacttttaaggtttctgaaattatacgtgtaatacactgcacaaaatcaagaaaaacaaattatacaaattaaattgcgcatgttttttcgcatattatactgcagaatatttgtttatttgaacagcttagctgacatcggatttaattaagtggtgttattcatacaacaatttttatataataatattttttttctttctccatttctattagattattaattaataccctgattgacaaaaaaaaagttattaatcatattttatatttttcttttctctctcccctactttattgtaaaatttgttatacaatattaacatttttctacttgattttgcagcatcaaaattcaaaagcataggaccataggcattcttgtttttcggcttctagtaatattccactatgctttctctctcttcgacttattctcttttctcaattctcattcaatatacctaactatcttttcaactccctttttataatttttttttttaaaaaaatctccttcaacttcttattcaagatgcctttcagctgcaatataataattgaaaaaactatgctaccttatggagcgttggtgggttgcatcttgtggagctacaaaacaaaactcacattcttttatttcatgtctcaacctttttctagaagggttttgatataaagtgctacttttaatttatttatttcaaaatttccctttgtttggaaatcgtttaatttcccccaataatttattttggcttgtagatatatgcatcccacttcaacatgacatatataaaattaattggttatcactaattacaattttatcaaagaaaaaaaaaagaaaagaaaataggtcagtaaagttggtggcttaaatgtgcaaactgtttattatataaaggtaaaaaatagtatggataactgaaaagattgtaaactctttaagtctttagtcttaacagatagatgcttaaatcaggatctcactaaaagaaaacatcaaaatcacatgaaaccttttaaactagttaacttttatatccttttactttggtattacccaatagccaatccttgaaatcaatctagaagcaactgctgttgatgataagaggtctctctagagaactgacttatttgacacttttggaatctccatatataatattttgatgccacgaataattttttttaagatatatagtttaggtgaaaagagaaagaaaaggataagcatatatagaagccactgagtaactcaaaaaggtgaaagaaaagaattacatattttttacatatggagttgccatatatcaacatctatatgatcgaatttaagctgagatgctgccactagcaagggagctatcattttgggaaaggtgggctgcatgagtgcttaatctacaatgtgacatgtgaaagttcctgttgtcacacaatgtgtgtagaaaaacagatatggtactatagcataccccacttcaatttgtttgctaaattctacgacgtggcttcaataattgagtaaaaagcttcattgaaagtttgatatcttttatcttcaccccctcatcattttcaaatgagttaaatgatctcaatattgaaaaaaaattatacagtaaatcaattagaaattatattgaataaatagtgtatgtaatgtattaatagtataaaatactttttttccatcattatttaattataaattattatatataataaaattgttaagtttttatcataattattttaaaaaattatatcaacagttatttctaactgacatgataatgtaaaatttttatattgatcaaacacataacaattatactcataattaattttgaagttaactattataatttttcatattttttacaagcaaagctttattagaaaacatagtacaagtcacactttaacccgtatacaatcaaatcatatcaaatgaaaagaaagaaagaaactgcaaaacctatacaccaataataagaaaaagaacactgaacatacattatctattttttttttccttaaaccatattcaaaatctaacttttatcacatctaaaatattattgaagacaattttaccatatataattaaatgaaagaataaagttccttacatgcatgcacactatttactctcttctaattaaacaattaggattcaagttgtttctataatacacaatcatcaaatactatagtagttgatattgagaaaatgtcaactagtaagtgatataagtcaagaaactgtggcacacattgctattttcgaaaatataaggtatcacacatgtacgcacaattctgctgcaattatctatcattttgtggctctgtatagtccaacatggatgcaacacaagaaaggcatgcatatggccagctatgccgctgtcttcctttgtatttaagacaaagcaaaactaagcaaaagcagtggctgggggatcctagagttttcttgcttagtgtgctacctacatcagattcagatcgttaactattagccataatttaatttatgtatatatacatagtaagctagacccttatagttttcaccaataatttagattttagaaacatagaacctagtcaaccacgtctctaagttattagcagccaagtctacagtgaatggtttccattttttaaatcttttagctaagcaaactctccgacaagaaagggagagagatttgttcactttattttttttttttcaattttcattttgtactatatatagttttataagttattttcactattaagaaagaaaacattgattacactttggtattttcaatatgagatttgtgtctaaggaattgaaggagagtacactttaaatgataaatggtagtattaataattataattactaattacttataaaatttgttgtatactatatattttatttttatcacaatcttaaatattaattttgtaatcaaccattataaatgatctttatctttttaagtaagatgtacttagtatcttttctctttcggagaatcagatccttcaagtgtaatattttccttttaaattttgctagttaagactgagaggttcacaaaatcctagttttatcgagggggtcattttcaatttgttgaacatatctattaacattaactatgtagattaattgatgtatcttgtataaattgataaattaatgtttgttgcagaatgcagaatgcttgggagttcgatgcttgcagttatagatgctaagaagcctgcatgttctattgtcagcttcctctgcaagaatatttttcgccatgcatatgtggaagtcaaaagtcactatctaagaaaaatgttgtatttgaagaaccaacatcaaaactaaaactattatctggacactgattttgtatagcattttacaatgaaaagaagaagaaaaaaagttttcaatttgaacgataaatttcaattaacctgtataaaataaaattttttaaaagtaattcaatgggaatgcatactaccattttaacaagtatatatttagtgttattatcttttttgttttctccatttttataattttaacctattgtctctaatttttcagtcgttgtcaaattttgtttctttattgacaagttttattcctttttaagttcactaagtactttttattcaactacacgttttattttatgccatgttctattttcatatttctaataatcatggtttttcccctcaaaaaaattaatcatggttttaaattgatcaagaactgaatttgcgattacaacgtaaaaggtttatggatttaccgcaatcttctcacaattacaattacgacaatgtcaaccgtgtttttcacaatgtcaataatcaatctcctaacaatcgcaattatgaccatgttaactatattttttcacaaatttttacaatgtcaagaatcacgtcaagatcgcaatcatgattcccttatgagttcaggttctagattcgtcaaaatcaagtttataattttaacatccaaaaccaatttagattttcttcttcaaatcagttcaggttaatctagttattggataaatcagactatgtccacccataactaatcctacaatacatgggtttccccatatgcaatctttaacacattgcaattaggtatactaccctttcaaaccacctcgctacctcactgaatttggtgacaattgtgccacttcacatgataattatctacacatgccccttatatgtaagaaatgaaggtactttccaaaacattaatgtggcattggcacgttaactaggacagagaagagaattgggtgcaaattcagcagcctgagctaagactatccaagagatgtgcccctttcattgtctcataaattggcacttttctttcaatgaagactcaagaggaaccattccaaagcacgccaaaggatttgactgcctactacaaaaagacaaagacaacgtgtccctttgaaaagaccctaccacaccactagcacacattcaacatgatcacgcaattgaatagccatgtaatgtaatttggcatatgccaaacaaactttggatgggaccattttttcattgaaaagataagaagcacagcacatcagatgaatgagagaaagatgcaatgcaacaaaggctctgccaattgcctttctctcatctcatccaccaatctaatttttgttcccataataaaagagcctcatattcagattccttgactatgaatgtagcagtggaactacgattttataagagaataaaaatctttttatttatatcacagtcgtacatatgatagtaagtaacaacatagggctaacacaaagagacacgtaaaaagcgttacattatgggaacacccatgatttattaacccataatataatacccccataccagacctaccaaatcataaaatatctaagacctaaacgattacatgggaagaaaaatgcattaactgccgtttgagtcaagagactttcacatgaccccctttaatgacacaataaaagtccttgatacacgagtttccctcttgtcattttcactggtaccaaattgaaacctcttgctgtttgtgaagagaatccattcctactccttgtatatcctccttgaaatcaaaggatgacaaatcacaaggggaatcaaacatcgaatggatagtattattgttgtggttggtatcaaaaggagtgttcatgttcatgttcatggtggccttgaaccggtcaaattgaccttcctctcgtgcaaagaagttcccttccaacaccattccttgaccggggaaaaaactgtcctgttcttgtaatccggcatgagaaaggttatgattttctacagctacacagttggcggaacttaggttcttgtttcctacaacatttgtatcatagattgtcataaggtcactaatcattttctggccatcctccggaactccaagaccagttagatcaaatgaaggtgcaaccaaacttgcagactgagctgtagtgttgggttgaacaaaggacttggggaatatgactggcttaacctcagtagcatggaaattgggaccaccaccataatctgcagaactgtttctatatgcacaattcaattgatgattgtccctggcagacctatcctggaaaccaaggcgaacttcactgtaagggcattggggatgctcacatgtgtagattttctgatccatcatcatgttgaagtcactagaaattttcctcttccggatgaaatctaggtttgtgacaacatctcccttcattggatgagaaggttgctgaattggcatccttcccctcattctctccatcccaaggtttgacggatgaagatggtcaggcttccggtcctcaacatcgaagttcggctcttcttcggccccgtcaacatcatactcactgcaatcattgatcaccaaggatccattacctccagcagaggagaatggagggcaatagtcagggtaaagctctctagccaaggtttcctcttggttgatgatggcaagccaggttgcactttcctttgcagtcattttgtcttgaaggcatttggactgcctcacaagcttgcgaattttggcgatatcaggggacatatgcttgatgactgcagtgagaacaccaaccttccacgccttctttaggtcatgtggtttcttgtaaggtggagggccttgatctttaggtagaccaatttgaggccaccattcttcattcccagttggccaccatggtggaggagcacccttctctagcgggaacctcctctgaggaggatcacagtgctgcataagtgctgacaagagagaacccaaggttgtgtcctgtaactcttgcaaggtgtgtggtgtaggaccaatggaattgcatccatcattctttccaggaattgcattatcggcttgatacttagctatggcggcaggaccatttcgatcaaacctgaccttatccttccaccattcgcgaagattgtctgatgctcccgtcactggcttccccttctcaggaattatcccataaacaaacccttgtgccttgcaaacctccatcatcttcagcatgtacttcagtattccatcttgggctcttgacatctttttcctccttgcctgctcttgggattgcctttgctttgctgcatcagtcccttccttggacttggtttgttctttcaatcgcttgtgacgcattttgtccctccacatcctcttctcgagttcatccatatccatttcttcatcactgtagtcatcctcaactacaggatacggttcagtttgcctcacagcaatatccccctccccaagagaaccacataacatatccaaatcgccgcagaaccccatatcttcaaacatcatcatcttttcccagataaatctccagaaaaagagggtttaacctatgagctttcaaatgaagtgagtaacaaactgggctccaaatttcacccccttcaacactataaaccactcaatttgaaaatttctaaagcttctaatggcctttacacctgccaaaagttaaaaacagggaacaattgagacggtgcaaagatcaaatgatacgttccagatgaagcgaatatcaaaattcaaaagcataaaatctatatcaatatcttgtatgagattcactagcaacccaactttcaccagcacattttttctttcattctcatccagccatattggatataggctaaaaagtaaaatctaaagttgcttatcacctatgttgcatagctacagtacaaatacatcactaattttaaagcatcgacgcatcatatcactaaatgaaatctcaaaattctcgttttttccccctaaaacaccattcatcaaaacagttattggatcaggattgttctgattgaatagatccaaatcaccaacaaatttaaaaatgaaaatagtcaaaatacaagcaccaaaagcacatgccatggttcaacgattatttaaaaaaatgaaaacatcgctcatcaacccatcatcaaacatatgacgactgaaaggtttcaaaattttctttccaaaaacagatgaggaaacaaatcaaaccagccatcaacaaaggatctaaggccaaaccaatcactcagaaacccgaaaacactataaatagcaacagtcagcaaagaatacatacatacatacatatatgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaagagaaagcacacaacaaaaaaagaaacaaaaacaaaaaggccagaattttatagaccaagcagcaatcaagaaggaactgaataatgaaaaggagatttttttcttcatgaggagaaccttaccagaagatccagaagtgggttttcttgtgtgaagaccaaaggtgaatagggagagaagaagaagaagaagaacttttgtagaccttgagcagaaaaaaagagatggaagaagaagaagagaaaagaaggagaggaaggtgggaagaaagagtgagtgagaaaaggaacagagtgttgagcattatcttgcttttattattgcttatggtggtgctcttggtgaacgtgtagtgggggtgtcgttcattattggtgggattaaaacattgataaaagcccaaatatgtggagtaattcaagtttcagagatatttataacattggtttaggttaatctcatcctaaccttgggagatcggttattagtatttattaaatcattaattatgacatgtaatgtgaatatgattaatgaagtttcagtttcagtttttactttattttagttgtgtgtggggtccgtgtgcgtatcgtatattattgaaacatgaccaatcacaaaagtccacttacattggtaacagacaccaatacaagcttttgtttaacatgttacaaatctcatttgaagcagacaaatgtcaagcgaattgattaagaatgttaaaagtagaaatatttttattaatatatatatatatatattatgattatttttatattttttatgactttttgtaataaatattttttaatcaatatctaagaacacatgttaataaacacttcaattatagtatatggttgtgttaaattcttacataataattaataactaagacacctaaatgatttgcctataattatatagattaagattatattcctaaattatgtgtatttgaatttttaaatattcttaaataataatttataatattaaagaagaagaaaaataaaaaactaaaatgcccatgtcaaaagatcaagaaagacaataataacttccacattcccaatctatcttttaatataattaaataatattgaattaattaatctatctatctattaatattttattaatataattcaggctgtctaagaggacacctgtcacttatataaggacctacccttaaactctagactgccaaagctcttcagcgctcaacgcatctctctcacttcttttttaacggaaccgctcatcccctatgaggtactaaggttttgtttatttagttgcaaagagataattgtttccatttaagaacatgtaattttgaagaggattaactgtgacaaaattataattaaaaatgctaatttgatttgtgttgtagtacacttaacttgaagaataatagtcatatgttaaacaattaataaatatatttcctattatgaattaaaagggatcgacatatacaacaattctattttatttttacttcttatgtcatacaaaataatatattaatgttatacttgtactgcagaatatgttcaaacaaagcaagtcagtgagaagattgatatattcaacctttgtggttatactgttggagttgccaagtgctaaacaattgatgagcactcatctcttgcagagtgggcatggcgctgtattttggttattgttagttaatgctaatatatatgtataagcaatttattttatgttttagtccatgttgttagttctctaacagaggtgtaaaatcgtcataaaataggaacacaagcaatgttaaatcgtagagtcagataaattcgatgggataaactaaatcgtaaaaccgtagaaaggaatataaaagtatactttaaataaaaaaattctgaaaacagcaacacacaaacactgaatcagcaacaattcgacaattggacagaacacactcccaaacacacagatcacttaacaaacacacaggttaggagtgaccaaatgcttgtcacatgcttaattagcttcattgtgtatatataattctaatttaataatcttgtttgtgcaggctattgggtactcctaatgaagaggtgtggctaggagtgagtaaaccaaggaactagcatgagtagccccaatggaaccctcaaagtctctcaatggttgttccaacttctgatcttggactggatctgctatttgtaagtttaagttgctccttagctaattctttttactttagtgcctactgttcattttcatttcattatatttttctctctttttcttttcagaaaacgttgaaatatgaaccttgcaagaggatttctgcaaagaaagcaatgggacatccttacttggatgacctgcacaagaggcaactttagaaagaacacattgatttgagatagatttggacgtagaaatgtgtcattaccaacttacattttgagatagaaagatggtatttactagatgggattataagatgacgtttcttctacacaataaaaataggattataaaataaatgtatctgctaacacttagatggtccatgagttttattaatcagagtctcataagttttgaaacaatatgaccatttttaatactcatcacattttatttagcagttttaatgccaaagataaaactgaaaatcctatatttaggataagatctcttgcatgtcactaattaattgttctattctaaatatgaaatttagatatgggtgtaaaattcctataaaaaaaaagaaacctgagcaacatggttaataaagtagaaaatattctaatataaaaatagttaattaatatttaaaaaatatcaaatgcttaagagaatatattataaaaaaattgcatttaaattatatgttatcatcttaatgacattgacctccaaatttttatctaaattttggccactgattgtataagtctataagagttcatccaccaaatgaaaaaaaaaaaattatatagtatttattaatcatcttattctttaatcttattcatcctaaatgaaaacttaaataaaaagagtggtagcatatcttgccagccaactatttaggagacaagtttagtacacgtcaatataatatcggtaaatattatatactatcttgtttaatgcatcaatcatcatcttataatatgcaagattgtgtgatcctgatctctagctaacattgtattcacaaaaaataaaaaataaaaaaaaatctcttacattgtgtttacaaattaaggtataacatttaggagaaaccaggaaattaaaaggttttcatatagacaaaaatatcctaacacataacaaacaatggttaggcaagtatttttttttttttttttgtgaatcattaggcatgtatggtacttctaactgacaaattaattttgtgtatatataacaaatccatatttcaaagtttattttctttttaaaagaaaacagtcaaatacccattaatttgtgtgacactaattaaatgtttaactttgaccttaacctcaacaattaataaggctcatatttaatagcatgattttgatatttaacgcatcataacttgaaatacttttgttcctttctgaaaagtgaaaaacaacatcttaaagagtttcatttgtggtcttctcaaatcccatatcgaccatcaatggtaaatgttttttcttctcgttgtatcagtttttaaatatttttcaattcactgcaattcatctttttctttcaataagtgaaattcatgttacgtatttgtagaaaattacgtgattcctttcgatgaacctaacctcgttttgtgcagtgtttgatgtcactatttatggtgttggcttaatatcatccacaactcattcttgagaagatgggtttgatttgaaattatataaatcatgtgtatgcgtacatctatattataataataattctttatggttacagattcactttgtgcttctcatcagtcgacaaggaaaagtaaggctcgcaaaatggtattcaccatactctcaaaaggagagatccaaggtacttatctctaattcaatataaaatgtaaatggtttaatctattttgacccaatgtgttagatcatggtagttgcacaaatcattggatctgaaagtattcaatatggttttatcaccaaaattgcatgttgaatatgagctataagtatgaatctaaattatgacaaggcttcgatccttctacatttataatgttattttattatgagtgacccttgtttgatatttttaggcatatttcatgttatatcaattattaatgtttatgcatgttctgttaaatatatgcactggatcatattcttatagcggttaattgtcctatgaaatggattttgcttattgatgtcttttgggtatacaacaatgcttaagtttttcttttaattctatttatgctttttgtctttattttatggaaggtaattcgtgagttaactggggtaattatctctcgagcccctaagctgtgcaacttcgtggagtggaggggattcaaagttgtttataaaaggtgggtcaagattgatcccttcattgttccctcagctgatgcatggctaacaaaatacactaaactataataattttaagactcttcattttggttattgtttagatatgctagcctatacttttgcatttgcaatgatcacgaagacaacgaattggagaccttggccattattcattactatgttgagacagtggatcgttattttggcagtgttagtatcgtaaattgttgaattctaaagttattaataatttgcacacatacttcagatcctgagtttgtttctcttacttctcttaccaggtttgtgagctggatttaatctttaattttcataaggtaattcattttctctcagactgtattctttctaataatgcacacagttcaacaatattggataaccctcaaaaaaatcagataatctaatatcatgttacattatatagtttatacggtaaataagactaggatccttgcaggtttgattgcagtcttcattgtaatcaatcatattttcttatttttaatataaatttgaaagtcatatataagtaagaatgctaatgatttaatgaaagaaaagaaaactactatgtactattcggtgtttatcttaatccatgattaaaattgagcttgatcttggcaggcatactttatattggatgaacttttattggctggagccatgcaggagactagcaagagaactactctgagatggataagtgaacaggtaatttttcttattacattttccacttctagtttaccataactatcatattttggacaaaatctggtagtctttaatcacaatagagtctgattttgatcatttacattaggatttactctaaaactcaacataagttactaaagtgaaagtctaattgtagttaaagaatagcagtaaaaacaacaaaggaattgcatcttaattttatcctcatactttataattaatcttgtgttttacaaaattctgatcttatgataatgagttacaggaggatttagtggaaactgccaaagaggaagccagctcattgagtaatataatcgctcaagctaccaagtaagagcatcactgaggattgaaattatgttacataggcagcacaaagttttcatgcgggtgaaaatttgttctatagaaaaatcattaaaaaaaactataataaatggttttattagttgttttttaatagagctacaatatgcatattaactcatatttgggttatacctagtgaataaatcttggttattattttattgagattgaaaacttgtttttcggatgatgtgtttttaaatgaaatggaaaaaatttataagtttggtaaaggatttgatccgttgttatcttaatattccatatagtttaattttggttatttttctctttatcttctcctccttcttttctccttctttgtttttaccttcttatttttcaacctcatcgtatatattattgggttcatctatcaccgaccttaattaatttgggttaaagatgttgttgatgtgtattgaaaacttgtttatgttcaattgtttctcactctatgattatttattgaaaatagtatgcatctaatgatctcatttaaagtttaaatggtatactatattgtctagtaaaagcagcagaactcggtcacattctttggcatgcttaccatatcataggcatttctcataattcttttagtagaacaaggcatgactaccttacatgaggtagtcagcatgactagctaactcacaataaaagcacaggaagactacagaaaccaaacaatgaaaggaagaagacacgaaagaaagttaaactaaacaaactaagggcaaacacatgtgtggctatctgctagtttcagttgtgttccttattcatgaacatcttgagaatgccacatgcaaaagcatccctaggtatactcttcacgttttgaacagcctcagcaaaaatgacacccattcccatgtgcaaatgaggctcaatatggcaatggaaggcccaaactccaggattatctgccttaaacctcaaagcagtccaaccataagggaatatcactgcagtgttcctcaatggtgggttcttcaagttgaatttggactcgtcaccttgtttgaatttcccatctccataccctaaaatccaaaagtcatgcccatgcaaatgccaagggtgaatctcactgtttttgcccttcattacattagcattttggagtatcaaatcaacaacttggttaaactgaaacatgtaaaccccacttccaatgtttgcattagggttcaagggaggtttcaagatgtcataatccattgagaaattgtcaggtggactttttgggtcaaaggcaccattcacattaaacctaatggagcctaggtaaggagttgttggcaatgctagtgagacattgttaatggcccatttagtgtatccatcaacaaggttttgtgtgttgagaaggaaaagcctacgatcatagtgttgaggaggttgttccgttccctttagggcaagaattttgtaagtgaatgccttgctacgattataatcatcccattgaggtgtgatgggtggtgaagaagggggaaaaactgaggcagagattgttttgtagtttaggatagttaaaccttgtggggtgttgggtggtcttcctctaacaccaactgaaatccaatagtttttctttgggtcttgatttgttgtaaggagaaccgagtaactttcaccagaatatatgtctatgtcatcaacgataaatggtttcacatagtttccatctgcttccaccaccaccaatttgtgattctataagcacaaagaagttaaaagcatgcaacacatgtcaatattcttcatgctgaaactaattacgtatatgcaactgcacatatacatattgatcgaagtagagtttttacaaaagattatatatggattagtaagtataattcaatcatgacgtaaagagcaaatgcatagctaggtaaccaactgtctaaatgatgctagtatcaatttcaattctacatactaacacagaattttgttatctctgttttctcaccaaaacttcaatattaaattaaagattagaaaaatggatgaaatccaaagataataggcatttcgagtattcgataacagaaaaaaaagttatgccagatatataaaaccttttacccatttaatattttttttttacagattttacccatttaacataataacttaaagttattaatagtgtgatatgattaatagataatagtatctcttgagctttttaaaaaaatattaataactaatttcttaatgttttgcaaaaaaaaattatatttaacggggtattatggcctcctcaactatacggtgtgcatggcatatataaaacctttagtataaactttaattttaacagaaactaagtcctcgtaggcttgtacaattttattttttctttttctttttccccgatcgtcgtgcaatcaacaaaaattgaactttgtgtagtgtttgaaaagaagaagaaaaattgagagaaaaaaatatgaataaagatacttttttttttattaagtgatgaagttttatagttcctcccaagtcccaaaactgaagaatccaaaggttaatccctgcaaccatgtgcccaaaggtatggggcctgtgcctgagccaggtagtaaaaatgacaagagctaccttttgtcttctctttcacgttcacgaccaatctacagagtacagcggcagtgacatctctctatcatattttatggaaatattgttttgcaacattttttttttatttttcccagtcatcgaaaataaatacttggtttaaaaaaaatactagtttagttctccgagtattaaattcatattttataatttataagaataattttttatattatttaaggtttaatatattattaattatttagtttaaattttaataatggtatgttagtagatatgtaaaaatataatttatacagttttaaagtactgtgatttatttaaaattttataattgatttaagattctattgcaaatagaataaaataaatataaaatttaaattaattgaattatgaaattatttggagggaatgaatatgagatattacataactttatcttatagaataaaatttcttatatatataataaactagtagattttttagatttatatataataaaaaataaatatatttatatataatatcaaatacaatattaattatttcatatttaaataataaaattccttattttaatttcattaagttggcatttttcatctccttttacttaccatcagattgtgtagaaaagaataaaaaatatataaaactcacatttttagttgcttttataaataattatattatatattatactacataatacataaacaatttttttttttgcaaattcaagataagatgctgtatggaactcgggttattaaagttagcctactctgacatttttcatggacatatgcgtcgcatgcaggtttatatatagagtttgtcttgatattaataggcaaatgctaacttggttaagaaactagaaataaaaagttttctattgaattggtaataaaaagtattcaaaaagaatgtgttactagtattttttattattgctaacagtattaaaaatagttaaaatataagactagttgttatccaaaacataaaatataaaactagcatgatgcatgctactaccaatataaatttcatgaaataaaatatacatatgataataaacttaccccaatggccaagttgagagatgccaaggaagtggtactagcaatcctgatcctgtaggtcttgtttggatcgacatggagaatctgaggtgcacattgttcgttacctctgaacttgcattggggcaaggaggtcttaataagattagctgccaaggaacaattgtattgtcctctcccattaataagcaaagactgaaaaagttaaatgtttttgaaaggtaagaaaattctttccattcaaatatctattggctggaatcttgcataggtacaacaataactaaaggaagtagtgtaggtggctttctttggttacttctacttctagagctattctcaccttgttactttatgcagtgaattaaatattaaaagatatttaataggaaaaaatgaatatttttttatgtatgtgattgcaaaatgagtatcactgtcgatcatcaagatttttaaatttttctaaaaattctagtgacactcataagtgaattgtcttcttcctaaaatgatttttttatacacatcaaacattattcgaccatgtgcttaagtcttagcccctagtcacttgaaccattgttggtaggacgaacatgtgaagatactattactcttaacaacattgtatctctcgcaataaaattcggtataatggttatattaaaaactctgaataatatttgcaagtaacagtgaaataattacaatcatttaaaaatatttggtaacaataggaaagggaaaacggaaaactgaaacagaattttaaggccttacaaaaatcgctctacttataaatattagtttacattttatattcttcttcttcttcttcaattgtttagagattcatgcttttttgttgagttagtttttttaaaaaaattcaaaagtaattttaacgagatttttactataatttcttttgaatacaaaaatggatcaaatacatgatacttttctagatatgatgtatatttaacactcttgtattataaagaatttaattttgatcctgtaaaaaaaaactaattttgatacattgtggatataaaataatttacaatgtttaatttgccaacgagaaatcatttgtgtatgatttttgaaataattattataaaacttaaccatcttattaaacatgaaaattcttaattaaacaataatataaaaaatatgtatactatttctaaattctaatcaaattcttataaaattttgtgaccgggctattagacaaaatcgaatgggcgtatcccatgtttattctataaaatagtataatttatatatgttttttctttcagaaatactaatagctagctttattttattatataaattcttgggacctctatatataagcacatgattaatagtatcttgaaaagctgatttggcaatggatttattgtttataaataaaaaaaagacacgtagccatgcataaaataaagattatcgtgaacattagtgttaaaatctacttgtcttcttattggaaattccttaattacttaaaaagtaaatgaatttctggttgaaaattgaatatgttgatttagcaagggagaagacttgtttgcacaaaatccaatatatgcccacttccactagctggtccatttatgttttcttttttccttttgctcagcagggagagaaggacaatacatgtatgtgtttctaattcgtttcgaggttagattttgatctgcaatgaatttggatccatactttcaagatatttcattatccatttttatattcttacatcacaagtgggagataagctgacatatgatatgtccttatacctcattaataatcctatgtttatttattcacataacaacatgagagaagaaaacaaaatagtaataatagaaataatataaaaatactatttcttttcatcccaacaaaatatttttcactttatttctcttttctttttatcatttctatttattttcttctaatgtatttcttctctatttcactgttaattcagatataagataatgaagagaaaaaaaaaaaacaaattacaatgacaaaccactttagattttttcttattacacacaatacttctcattttttaacgtttacaacaacttttcttacatgaatgttagtgtaataattgtcggtataatatatttttcaaacatttaaaggggttaaaacagaaataaactagaaaaagagtaatatcgtgtgtaattatatataaataaataaaaagttcagggtgttggagtatatataatttgctaaaaataaaatgatactgtgtgttttgttcgatttacctgaggttcgttaatccatctgaatggcatggaggagagaccaacctcttgagaatgtgtgcttttgtgccaccaatcactcagcaaaaggttgaactcaccatcataatggaatggctccttttttccctttggcaaattcactatcagagaaccatacagtcctgctgctctttgcataccaaagtgtccatggtagaaatatgtacccgcctgcaccacgtttaattttacccatggatattacaacattaactcatatatattttgcatacattgaccatcatatgcataacacatccatgttttttaaaaaatgcaatatactgtaaaaaaaattattaagtctgtttttataagtataacatttttttaaaataaaaaatagataagagatgcttttggtgtctcaaaatattaattttagtccatatagaaatttaataggttttcggcctctacttttatccaaaaacacatgtttttagttcccaattaaagactaattaaaatcatatcactttttgataattataggaactaaaattaatatttcaaaataaagataatgtaacatataccataagtacttttttaagggataagtacttatagctagcacatgaaacaaaataaagagataaacataatttagtatgcaaataccctgtcaactgtaaatgtgtaattaaaagtttctccaggagcaatagcacactgtgaaatggcagcagttccatcagcccaaggtgttccatactgcaacatacacaatacaccccaaaaaagtgtacaagtttaatattcgatcatatttctatatgtatgtctagacagcgaaagaaaggaaaaaaagtatatataaaacctgtctaattccatgccagtgaataactgttccctctgtggagagcttattggtgagtaaaatctcaagggtgtctccagcttcagctgtgatggttgggccaggaaactggccattgattcccatcacaacgtgctcatggcaatctggctcacgatacatgtactctacattaaacctaatgcggtgcattacagctcctagtgatagttgcaacaaagacagaaaaatgcaccataaggttatagctttaaagctcattatattgttattgcttttgctcatagctagagcctgaattgaattagaagaggaggaagttgtcaaggatttattagaagctgttgatctacaatgtaggttgtggcattataggtccttgcgagtgggtttgtatatatagagaaaggaggcaatacattatagagaggtagacttaatttatcacattcaacatgttgcaatgtggtatgttttcaacttttgtgttataaatttttatttttattcttgaattaatctaaaaatatatcttagacaaatgttaattttataatattttatacaaaagggtaaagagatgaaaacaaataaagaaagaaaaaaacatgtgataggttaaatagtatgataaagaatatatatatatatatatatatatatatatatatatataaacatgatgtattttttgacatatttttgtcaaatattatcaacgtgtgcaccatcaattgcacataaggaaataacatatcattaagcacaaacattaacggtaccaaaggtattttaaagataatagagtgaaagaattaattttactttaattttaaatttggatccataggtgcaagatatttcattttctatttttatataattaaatcacatgagggagattggtacatcaagcaagcatatgatatgccctttcactatatgccttaagagagaagaattacacgatgtatgttttgtttgatttaattgaggttcgttaacccatttgaaattctgaattgcttggaggagaggccaacttcttgcgtatgtgtgcttttgtctcactcatcaaacatcttccattaaagattacctaaaataacacccaaattataataatacacatctaaaatgagtctgacgtgacactaaagaaaatatacgctttacaaaaaaaactatggtaacgttaaattaacaagaaaataacatatttgggtaataagtgtttaggacgttaaatgcatgtttagtttcgaaattattattttaaaatcttaaaattgatataaaaatatattttaaaataaaattaattaattacccacgtcttttgtatgtgaaataatttttcttggctacttgtggccattttgtataaaattgttttttatttatcgctcagagtccaattgcaatcgtcattttctacctacggacccactacaatggccattttcttttttgtttttttttgtcaaaaatggtagttttcagcccagtttgtgtctggtactgcttgttgtattggcaaatataaagtaaggcttaggcccacaatcaagttaaagtgattactgattaaatgcacgtttgtgagtttgtctgtataaagtttgtacatgatggaacaatagcagaggttcaaagaaaattttggtggagggaacaattgaagatcaattcttttttgtgttttttttttctcaattgaagattgcttcttgagtaatatgtttatttttaattatttttcacaaattattttttattatcaatttttatatagtataatcatctttactaacttcacagtattccaccacttatagaaataaagatgaagagttaaagagaataaaatttctctcttcaagcttaaaaattataaatatttggatatacgtaaaatatgtgcatcgagtcataaaccagaaaaaaaaaatgcagaatctacaaatagtagctttaatgaaaagctattaaccaaacacaaatatacttgtttcaaattaagaagggagaaaactaattggcagatcttcgataatttagtttctaaagtatattatatatatttcataagagtaaactatcaatttgttctctcaagtattactttctcagcttctaaatggtctttaaagtaataaaattatataaacaattctttcattaatttagtttatgcagtgatatattttactaacattcagaacataatttgaaagatttttcaatactttgacgggttgtataatatgatttataatacttaaaagattatttctattatttttttggtagcaagaaatattatttatgtattttatttagttcgagagtatggttatatttgataaaattagttggtatttaataagattagttgttgaaataactaaaaagtgtaaaataaaaaaattatgatttatttaaaaaggatacctagaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaaaaacttatttttcgaacaattaaacaaaattttcaattaataaaaaactaaaaaataactaaaatatctaaccaaacataatctatatgagagaatgtactttataattgcaacaaaaaataaaataatactttagaaatgaaattggtgttttattctgttccaaaacaaattttcaaaagtattaatattataatgcaattaaaaacttagcctaacttcaacaataactaaaaaagttgggccagattatacacttacatcatgatttaattacaaacattatcatatataatcaatttattaactttaataattactataaaaatcatatatcagcagttttttttttattactaacagtgtttttacacttatgtacctagtcattacatttttttttattactaattaacagtgtcattacacttatgtacctagtcattacactataattatttagcagcacaggtaaatttcatagctttttggaaggaaaagagtattgtattaataatattatccatgtccattgatcatttatcaccagttgaagattaatcttagtcgagttatcatttcagcctaaattaacatatctgtttgttagcaggggttcaaatttattgatacccaacatatgatggaattcatgttgtcagattatatgattgtgatgcatatttatcattgctggaactatcgccaaattatattaacatgaatgacttaaaaacgtaaaagaggagacaaaaaaaatatgacaaaagtgtcagaagtgggatttgaacccacgccctctcacgaggaccagaacttgagtctggcgccttagaccactcggccatcctgacttttgatgtaagtgcgttaaccactatttatacttctattctatttaaataacaaaatttctctgaaatgcatttctataatttttttttatcaaattaaactactttaaatatgtgctcaattataaattattgtaattgaataaaaatcttcaaaagtatagaaattagttttctttaacttgtaaacatagattgaatcacgtctagaattgtataattaaaaattcagcattccatcctacaattgtttgattcacattgaagtttctttgtgctcatgtgaaactagttctatttgaagcgttcataacctatgtaggaccaatatcgacacgacgtttttgatatatttctgatacagaactttgatacgttcttcaaaattccaaatatttcgatacattcatgataggtcttagtattaaataatatttttatatatagagtaaatttcttattaataaaatataataaaagaaaaatcattagcatagataatagattatacatacaaaattaataaatacttcaattaatgtgtagatatggaggaagaacaaatttgattctatttaggggcaccttttttttaatttacagaagtgtcttttgaaaatatttgactaaaccgatacgtaagatatcgatatcggacgtgtattcgataagttgaaattttttttttggaatatcggtacttcatacttcataacgtcttatctctagttctttgaagtgagacgattctgaatgctacaataccaacatgatttataaataaataaagtatcagagcatacatttgacaaaaatgaaaaataagtgagaagaaaaatgaataaaaaggaggatggaaaagattgacatttttaatttaaggtcttgttaattagtatcgaacattaattaagaaaaaaatatttattatataatttataagaaaacataaaaaagatcattgatagtacatttttccatctcacaacaaaaacacttatatttatgtttcttaatcaatacactggttaacatttatcttcaatttaaccaattcataaccaagtaaaatatggggctcttttttagttaacaagggagatgatgcaattatgtcttaaaaccactgtgtttctttaatgacgtgattgattcaagcatgatataaatagaacatcaaatgctccaaattttccgacgacgaattataacatcgagtactctaatggtgagttgtttgaaaaatatacaacacaaatagtctagccaaaaaaaatgagcttatttgttccgtagttaattgccaattgaagccaacaatacattcagatggtaagaccaattcatttgaaaaccagtaaaccattcccccaaaattaattattacacctccagtgttgtttaaaatgatatttaaaattctgagtggttaactcgaaccatcaaaaggtaacacaagattcctatctgtgggtcttgtttgccattttcattgcatcctttgcttgataagtgcaccttttaaatggaacaagatatatattcctaataacttgaaccaatttgttaagcaaaagtcaagaggattaagctcagttaattgaataaagatgcaaaaactattataaatcttctaatttgtctttggttattacggataaaaaaataacttgaaccagtttgttacccgtcaattcacgagggataaaccatctttaaagaatttgtctccctgcacacgatattcagtgacaccaagcaaaagttacatatgtgaagtgaataccacgacgataaacacatgcattgtcattgacaaagaaacaaaataacatagaatggagagcaatacgtcacacatattttatcagagtgactaagtcgatttttttcccctagtatttcatcaatagatattcaagtctcaacatcattgtcagatcataatattgttacaaattccaatgcccttcagtatgtaaatttacatataccagagattacatttaccactgcccattacactatgaggtaacacttaaattttagaatacatatatataattcaacgcagattgagatcctaccacatcacgttattcacgagcagtttgtatcataacttacaagtcccaacaactctggaccttccaaacgaggattattctcaaagctacagcattgaaacaaaacaacgcttattcaacaagtaacaggaaagaagaaagataaccagatagcagaaaatattttcaagctaaaatctagaaggcaaaatttaaatgattacagaatcagtgcaccagaaaaatgcaggaagaccaactataattaactgtataggacaataaaatgcaatcaaattccctgtcatcacaaatacattgtaacagggaagcctcccaaaagctgtgtcaattcctactatcccatgaaacaattggaaattgcctatcacatacactttgtgtcatcatcacacacaacaaataacaatcaaatattatcatcacaatttaacaggacctccataaatatgacgtgaacaggacccccacaacatcttaaccattaagcaataaaaattgcaagcgtgatatagcagcatttagcagcgaaggttactaaatttctcattgttacccccttccctcccccaaggccccaacaaaaaaagaaaaagaaaaggaaggaacaatattaaaaaaaggtgcagaagagaagaaaataagactcgagtgaaagccaacatgaatagcaccacatggagaataagaaaaaagctacatgcttagagttaagaagaaattacttattcaatggaatatgctcgaacggcccagaggtaggaattgtaccacataaatcattattggagacatccctgaaaataaagtgactgtttaggctctttgaaagcataaatcttcacgataccaccaaataatgttatcatgatcaacatataaagacaagattgttacttacactactttaaggcttgaaacagcagcaagttccttggggattgggccagttagtcggttgtcattgagtcgtctgcaaagaaaacacagttgagagaattatgaaagtgctgaatatttattccacaaaataataatcaaaagtctcaccatatcatattgaaacacagcttccaacacttcaaaatgggattactaactcagattaatattaattaatgttattttaaattgtcacttagcttccaggtatggctgaataaatttcagactctgggaaagctaaaagctaggttgaagtattttaccacctaaaaaaggtaaatagctttctatgggtcattcactgactagtggtttgatttatgaaggatattgaattgtgcttagacatggtccattgaaatgtttagatagaacttttaagtttgtttagaattgaatcataccactgaatgttgggactgaagtcatctcaatttaatcaaaatgagtcatactagaatagtaaaatcactctttcactcaattatggtgggggggatttaaggggagaaatttttcacactgattggactaaattatgctttacttaatggcttcatttgtctactattttaaggatatgatagtaaattattttatttcctttgaactaaaacactctgttgatatttcctcctatgaatgaggtttatatttgggtttgagcatgtgaattttgaaagcaattcatttcatatctactgtcataattcatctgtcttaacatcaatatatgccctacagtcaacatcttaacaccaagcacaaaacccaaaattgtccatgcccaaacttaatataaaatgtagtcgataagttgctaaccaaaggttcttgtcctttgcctgcatcattcaaagtcttgtaagaaattcaaatgaaagaagggaaagcaaatgccacagatctgtccagtcaagcttaatatgttattaaacatacttacaaaaagacaagattattcaatttccccaatgaaggtgggatggtgcctgatatgttgttgttgtacaagtccaagctcactagactcttcaggtttccaagttccggaggaatagttccttgaatgttgtttttgtacaactcactacatccaatgaaaggaaaaccacattaaacactaacaagtataaaattctatagttcacaacaataagagagccacagcaaataccaataaatcaatcattttagtaataatatgagcacaatatgaaacactgtcttatactttcatttgttttacgtctacgatacatatccaaaaccaatactcttggatacttcaccaacacatatctatgaagtatccaagccttttaaaaaaagtcatgaaaatataatctaatatagctacatgtcaaacttcaaacataatatagaaacatagaagcattgttccttaatgaagcaaaaaatgaaattgtcctctttatggatgatttcaagagaggaatgagattgatatcattcctacttatagacaatagaaagtgatttatgatgacaatgctttatagtttttattttattcatagtaatgtccaagaagtgtgttcttaatttggatttgcaattatatgtttattatgttttatgaatttttatacatatctacaattctagatattcatctttcacatattgtatctgatatattttatgtatcagatgttgatggaggtccacatacatcagatgtttattatgttctatgaatttttgtacatatctaccattctagatattcatctttcacatattgtatctgatatattttatgtatcagatatttactaattgtatcgccgtatcggatatgttttgtatttgatacatgcattgttctatgcatcataagagcataaataacaaacttaaagtcctctttattcctatttgacaacagaaagtgatttatgatgacaatggtttacaatttttattttgttcataagtatcttaacgtaccatatctgatatatttttaggataaccgcattaacgtaccatatctgatacatgtattgtgtcaatgcatcataagggcacatttaacagacttaaaaagtcacaatatctcgaaaaaaaatgtaaagcaaagttagaaaacatacagatactgtagatgctccagcttcccaagttcaggtaccaaatgtccagataggttagagttaccaagatccctgtagaaagcaccataattaccataaacatggagagaatattaacagattcagtcaattcaacacattttagttagcatttcagtgagacctagcacaacggtaaagttgtgccttggtgacttgttggtcatggattcaaatctggaaacagtctctttgcatatgcaagagtaaagctgcgtacaatatccctcctccttatattggcatagcgagaagcctctaggcgatagggtgcgtagttttttatcctatctgatacatttccggatccaatactcatagataattcaccaatacaaatatgtgaactatgaagtatccaagcctttaaaaaaagaaatgaaaatctaatatagctatatatgagacatagaactgatagaagcctgtatacagtgtaatacagaaacatgaatttcacttgcatattttaattgtttatgcatatctagatatgcatctcacacatattacatcctacatatttttaaaaataattgcatgagttgaatttcaatttctatgtattgtcaatcaatcaaaaatcattgttggcataacttttagggtaattattttaaaagtcaacaaaatttccatatatgactatttactctatgtatctatacacatatcgtatcaatgtatcgtatcataagcaacaataatcccccgtccagaaaatcaaacatctaatttaaaatacataaaaaagaatcccagtgatggagaacataagaaagtatctaaagacaacttttaatggcatgtataatttgacgattcccgcaacctcgcggaggatccttcaatttcataagcaattaacaaaataacaaacctcgctaaaaatctaaaatcagcaagcaccgcgtaataataaaactgatagcagtagtataaataaattaaagtaacatatagtaacaattaagaaagcaacaaaacacaaacacacacacacagagagagagagagagagagagagagagaggatgcatacactcgagtgactcggttgtcctggttgcaggtgacgtggaaccaagtacaggggctaacgagagtgggatcccagctctggaggacgttgtcagggtccgagaggctccgtttcagcgtgtagagagcgtcgccttcggaatttgaggcggcgaggtgagcgagagttagggttacggagacggagaggaggaaccgcagagaagtgcgagttgctactgccatcgctgatctgagcttcaaccgaacacctctcgttgccgccgtgttagggttcactagcagtgagctcttattggaggaggatgcagcaatcgcgctgcaacgaagaaagaaagaagcagagggaggaggaagttctagagagagagagagagagacaagggagagggaagaatcttattatggagagagagagagagaaaaagacttgaaaaggaagtatcggctttgggaataacacatagcagtaaaacatggcatgctcgccctcgcttcatttttataatcttccttctattataattgttatatataaaagaaaaaaaaattatattccttaacattaattaattatatttttttattatttacatctcttataatattaataataaaatttgtaaataaattaatatcaatataaaattaatattattttatttattaaatatttttaatctatataaaataatttaggacgaatgttattttgaaataaataaaatatttagtttttcaaatgagtttttatatcttcaattaattcaaaataaattttgattgaattttttaaagagaagaaattaattttgacaaataatgaattagtaattttaatataaaaaactactacattttcataaaattaatattttttcatatatttattaaaaaacaattccactcaaaatactgtcaaatagtcttaaatatagacacatctttagaagaagaaaaacggaaatgtgattctctaatacatttatacaattaattttatattttatatatacatacattaaagatcacatatatactaaaatagtaattattatttttttaataaataaaattactttattttatcttcctttgtttttaaagagtcgaatcataaacttaaaaaaaagttgaatcatagaacagttcttatcaaaattaggaaaaaaattataattatttgtgattagatgtatggttaagtacattttaattaaattttaaaaatattaaatttgtattagtttagacattttttctttttcaatttcattttaaaaaagttccaattggttttttttacactaattttgattagtttattgtttatatgttgttaatataatatttttgtactactaattatattaaaaaatatgttagatatagtttttaaaataattattatatattattattactatgtatacacacatatgatataattatatcccttgaataaaggttttggaaagatggtgaacaaaacgaaaaatctttattttttattctgtttgtctcttgatttctaatattcacttttttcgacaattttctgtacttattcatgagcgggtgtcacgcacagacgcactaaagagagggaaagaataattgtttctctaaaaacgaatgaattgataataataataataataaatctcttatgctatatttttatatgacgttattgtaaaaaaactgtgatttatttcctttttcaaagatattagataaataacatcttaaaaaaactttaaatttgttgatgtatataaagagaaaataaacataaaattttacataatagaatcatataaaatacaacttaaaataacttattcctatgagttgtataaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaaggacaaaaccacaaagaaaactacaacgatctagaaaattggatgcctacaataaataataaataacaaaatataaatgttattttttaatatgtagattttaatattctaaaattacatgtaattaaaaggaaagtgtttaaaattagcaacaacaacaatattctgaaaaaaagagagtaaaagtttagggttcattttttattgatccttaaatataaaataaattattattttatttatgttcatgatctctaaaaaagttaattattatttttcaacgattatttcaactcaattccatgatcagatataattttaagattatggttgaaaaaataaacatttattgtttgaaataataagtgatgaattccttaatatggagattaagagtctgtttggatgttagtttctctagaagtatttttagaaaagaaaagtaagaagaaaaaaatgaaatgagcttttttataaggtaaaataagtatttcattaactaatttataaatatcatctcatcttttagaaaagttatattagtgagcttctacaaattagctaatgcttatttttacttatgaaaaaatttatctctttttttgtttttattttattcttctagaaatacttatagaaaaacttatcaaaacatatcataaaaacgaaatagaagtgaaaaagaattaggaagaaaagtggcatattgtgtgtgcaaagtcgagtacattttggtaagtggcgtattttgtgtgataatgctaagtttgtgcaaccaccattactgacaccacctaaagtggttgggagaatccaaattggtttaattattttatggctgtggtgttacatcctcacttttgtcaacggattcatttatcttataatcctctttttatttatatgaaggataccctcatctttctatctcaggtgtattgcttaagtctataaaaatagaacactgtgtaacaactatttattatatcagaaacatacaaatcacttcaagtaattgaaaattgttaaaaacagtatctgatggagtataaagaaaaaataatctaaataaccatataaaactagttaatattatattttataaaataaaataaaaggctaacttctttacaaaattattttgtatattgtagccttggaaatatgatattttcatatttgatacgtgtctctctaaacattttaaataaaagatcagaagttaaataaagttaataaaaaaaaaaagtgaaacaacataaaagtagtcagcactcagcagtaatttaaaaaaaaaaaaaaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaaaatttgcataacataaatgtgtgacattaaatattaatcatctatatttattatatctaaatttaaccattttactttgatataaaatagatttctctttcctattattattattattctagttaacgtatgaatctaacttttaaaaaaatgaaatatctgatttaaatttatttatttaattttaaaaccaaataagtataaacaaagtatgtacttttaattacagctaaattaatcacgtatgcatattttgtttagaattttaaacatattcatgtattgtcaatttttatgtatcttttcaaaataaaaaaaaaaataacgttgtagtaaaaaagttgtacctgctgctagttaaatgaacatgatttctaggataaaaaaccaattattattaattttgcacattgatgtctccccaaaattcatttattcgcacccccagcattatccacaccaaatgctacgaacgtgaatacaaaaaggcattttatcgaaagaatcgatgtttctctttattaaaaaaaaaaaaaaaaaaannnnnnnnnntttgaccaatattcattataatatgatatttttttaaaaaaaatatggtgtataatatggtgttgtttcaccaataatttttaaaaatattcttaaaataatcaatattaggatacatcttacaaaaaaaacatgttatatgagaatgttaaatgattaaatttaaatagtataattatatatttaagattaaaatttaatgttaaaaagttacataattttttttaaaatttgcataacataaatgtgtgacattaaatattaatcatctatatttattatatnnnnnnnnnnnnnnnnnnnnnnnnnnnnnnnnncgaaagaatcgatgtttctctttattaaaaaaaaaaaaaaaaaagtagtaacaaatgctgagggaaatggggcccactagtgcaaacgtaatgaccatgctccacctttacgaaccgaatcccaaaccgtcatcaaattttgcctagaaacgtgatcggatctcagccctccacgtcatcacaccacacctcatcatcaaacgtccgagagcgggtaacagcacaaactgcatagagcgtcacagcagagtgcgtcatttatttttattcttcgtagtcccccagaggaatgagaggatgcgaaccggtgcacattctctcacattcactctcgctgctgccactattaaaagagtgaagggagcgagtcataaaatcacgcttcaaatcatttgcattcatttttcttctctctgcttcttctgcgccatcttagggtttgggtttgtgcttgctgcttgcttctgtcactgattttctggtgaggaaaacgcctactcttcttacctcattaattttgcttcgttttttcgttgctatctgtcatgatcacatgctgcatttgccattttctgcgtttttcttccgcttatttcgtcctcagtgcttgtttcaccgtttaatcctggcctattgatggtttagcgttttctgctttcgaaatgcttcactgtagtttatgttctttcattttcctgcgtttttttttataatgttttgttttgctgcatgtgtttcggctttgatcgtctttttttgcatgtttattttgaagaggaaacgctttcgctgtgcttcgttgaatttaagctcgtttttgcttccgaggagaagcttgtttgttagaatcttcagtgcttttttgagtttaattctagcggtttcattggttgtgatttgcctgtgtcgttgttttttttttttttttgcttttttaaatttttttagcgaacactctgttttggtgtaatgatggttcgaatcgacggctacagagtttaataaaattaatttttcagagtgttttgagtttactccgtgctttttcactgcttgtgatttagccgtaacatatttcttttgcttttactttttttgaaagagaaaactctgtttgctctgatgatggtccgaatcggtgaccacacctacttatttttgggcatttgtgttccgaagccagatatttgcttcagggtacctgattttggcctccgagtatcttttgtgtttagttgtattattgtttaatttcgtttgtatttgtattttattttttttataaattttacttgttttagctttttacgtcctccgtgctgatgtcgtttactgcacttttgtgtattttattttgcttgcagtgcatgtgattatttctatgttggtttatttgtataaaatgcgttttgctggttacttgtttgtttcatcattttgagttagaaatgttgttctagattctatattctccccttgtaaatctatgattattttgctgtttatgatagttgttcctttttcattttgttgtgcgaaaatgttttactatattgtttttcgcatgattagagtttttatgtagataatttatgagtattttgttgcttttaaacttcttttctcagtaggtttatttgtataaacgcattttgttgtttgtttgccttttacgcttcctgtttgagtaataaatattactctaggtttttgtttcccccctcttaaattgatgtttatttttcagttttatttgcatgatagcggtttgtctcttttttttttgtatgaaaatttgttgtaccatagtgttggcgtctgcttagatatgcatgtggacaatctcaaaatatgtagttatttttcaaattttttgttcgaaggaatatgtgaagtaactacttatgttgacacaatttatttaatgcatgaactatgcagtagatggcttctttcgggccaaatggaactgagaatgaggattcgttgcctcccccacctcccgttgtaccatcagatgttgtacctgttaaagctgagctggagaagaaaaaggcttcaaggtttccaatagccaggcgtggccttgcttcaaaagggacaaagctacaactgctcaccaatcactacagagtgaacgttgcaaacactgatgggcatttttatcagtatagtgtatgtgctttcattttcacccgcattatttatttcaggtctctgtttaacttggaatcatttattcaatgtttatgtttgaacaggtcgctcttttttatgatgatggacgacctgtggagggtaagggtgtagggaggaagcttctcgacagggtgcatgaaacgtatgattctgaattgaatgggaaggattttgcgtatgatggtgagaagactttgtttactctcgggtctcttgctcgcaacaagcttgagtttacggttgttctggaggatgttattgctaccaggttcaaatactgtggatgctaattcttcaatttgacttaactttttactgtttcatctttgtaactttttttttctgtaccaatgtatgttatagaaacaatggaaactgcagcccagagggcaatgaagaactgaatgagagtgacaaaaagaggatgaggcgccctaatagatccaagacatttaaagttgagcttagctatgcttcaaagattccattgcaagccattgccaatgctctacgtggacaggaatctgagaattatcaagaagcaataagagtgcttgatatcattttgaggcaacatgctgctaagcagtgcgtggattatgatcatttcttttttcttctattattattattattgataacattattgtatcagcttgcctttgtgtgtctcttatgttgtaatttaaaataataaaataatgtcaatttacagagggtgtttgcttgtgcggcaatcgttctttcacaatgatcccaggaattttgctgatgtaggaggaggtgtacttggttgctggggcttccactctagttttagaactactcaaagtggactgtctttgaacataggtttgatctgttgtttgccttggacactacatttgtttcctcataatttttattaattctgtcttgcaatatgtttagatgtctcgaccaccatgataattacccctgggcctgtggttgacttcctaatatccaatcaaaatgtgagagaccccttttcacttgattgggcaaaggtaagctaattcaatgaccatttgatcatagtacttgattgattgccaaatacaataatctcatcttttatttattttcttgaacaggccaagaggacattaaaaaacctgaggattaaatcgagcccatctaatcaagaatttaaaatcactgggcttagtgaactcccttgcaaagatcaaacgtatgtcattaattctgcttttgttcttgataattaattattattaattttagagatttttaattatcagggttagggtgttgtaggtttacattgaagaaaaaaggtggtgatgatgttactgaggaagaagtgacggtatatgattattttgttaatattcgcaagatagatcttcggtattctggggatctcccatgtatcaacgttgggaaaccaaaaaggccaacttacatccctcttgaggtagatttggtgctttatatgtttgttcaggactttgaattagaaagctattgattcttctttgctgcttaataactttttaactttttatgcttagctgtgttgtttggtatcacttcaacgttatacaaaagcactatccacacttcaaaggtcttcattggtggagaagtccaggcagaagccacaggagaggatgagggtcttgtctgatgtatgtgtctttttgtccagttttgaatatttgggttgtatattttctggattacctgatgttaatttaattgttacaggcacttaaaagtagcaattatggttctgaaccaatgctacgcaattgtggaatctctataagccccaattttactgaagttgagggtcgggttttacaagctccacgggtaaattttaagtcattataattgtgcatgtgcttattcatttttatcatttattgtctgctatatcttcatttaaatagactgttagcgaatattgatgaatattgtggtggtgacttaattttgttaatattgtgctcagagaggtgtagctttaaatattgctttgcttaattgtctaagaatagttggtaatataatcttcatgttctaccgtaaccaattctagttggttttgtatggaaatgtttgtcaaattattaagatgtagttttatttgttgttgatggcatcttgttcgttaattatcaatgttgtgttctgtaatatgggtttcaaagctgattattaaattttcgtttgtagttgaaatttggtaatggggaggacttcaatcctagaaatgggaggtggaacttcaataacaaggtatgtcattctactcttgtattaatttcataaaaaaatgatttgaattttctaataattgaataattttctccagaaaattgtcaagccaactaaaatagaaagatgggctgttgttaacttctctgctcgctgtgatgtacgaggacttgtgagggatctcattaagtgtggtggaatgaaaggcattgtaagttttataactgcagattgactctgaagcataataagttgctgactatatttttctcaactgcaattggtaggtgatagatcagccgtttgatgtgtttgaagaaaatggtcagtttaggcgtgcaccgccggtggttcgagttgagaagatgtttgagttggtccagtctaaacttcctggggctcctcagtttcttctttgtctgcttcctgagaggaaaaattctgatctttatggtaagttatttgataagttttgtcttttgtttactcctttcatgcagttgtttaagtccccttattgatgaaaattaactgaacttggtaaggtccatggaagaagaagaatcttgctgattttggaattgtgactcagtgtatagctccgacaagggtcaatgaccaatatttgactaatgttctgttgaaaatcaatgctaaggtatgttgtttcttggtttaattttctatttttttggaatatatattgtaattctttttgttcagtttgtcaggattcattgttgtacctgtcattaaattttttattgttttgtagcttggtggtctgaactcaatgttaggcgttgagcattctccttctattcctattgtttctagagcgccaaccatcattattggcatggatgtgtctcatggttcaccagggcaaacagatattccttcaattgctgcggtattttaattagtgcttgttatgtgatttttatattgggcatctgtttcaaacctatgattgtcttagtttgagcctacttcctggttattggaatgttttatgactatctgattatatgctaatgcttaaacatgcaggtggtcagctctagagaatggcctctagtatcaaagtatagggccagcgtccgtacgcagtctccgaagatggaaatgattgataatttgttcaagaaagtttccgacaaggaggatgaaggcataatgaggttaatctaattttgtatcaaatcattgaattaatcctcctagtatatttatgatatcatattgttctcaattttttttaacattaattttgaatttggttatgtgaaatgatcagaatttggtttctaaatttaagtgaatttaagtgaatgccagtttagttgcaattttataaattataaacagttttttgtggtacctgtttattttgtggtttgtattttttggaattggacggtcattggtgtgctgtatatctgcagggagcttctacttgatttctatacaagttctgggaatagaaagcccgataatataatcatattcaggttactttttttctcattttattctgtgaaatatgtactttatttttagtttttataaatttttttgagttgtgtgtgtgtgtgtatattgttgttagtctgttatctagtattgtggtggttaatatgtatggcagtttgtgtaatatttgattagtttaaaagggacttgattgatggtcttttttagtgttttgaatgataaagttgtatgatacgatccttgttatctgttctgcaaatctctttttatgtcaccaagacaaatgtcaaaagcttatagatttaacaaatgcttctgtttagtttgcaaatcctgacctattttatgttagatgatcagttgttggacctataatgtgtatgttgttatatatgtgtatgtgtgaactgaattgtatatattttttttaaaaaatttatttgtcttcgtccttttttatgtctattattttattagttcttacatattttttcataatgaatctttttaatttgtatgtttgttagttaagtgacctttttgtgtattttgaactgacctttttttggctggatgtagggatggtgttagtgagtcccagttcaatcaagttttgaacattgaacttgatcaaattatcgaggtgcttatttattgagctgatgaatttaaattttaaatatttgaagtgtttttggggttaatattgtcttctttaatattaggcttgcaagtttttagatgaaaagtggaatcccaagtttttggtgattgttgctcaaaagaaccatcatagtaaattctttcaacctggagctcctgacaatgttcctcctggtatgcatcttgtttattttgaattttaacacgtttcaataatttttgttttgttatttctttactcttttatttttgcaggaactgtaattgataacaaaatttgccatcctcggaattatgatttctacatgtgtgcacatgctggaatgattgtgagtatctgctatttttttaaatgtggttttggttttacaatttgtagttccattattgtggctcctatccttttgttgatgtaaagtgcacaaatgttctttaagacgcatgtacattcatttcacatggtgaaattgttttcaaattgaagtcgaaggtttctggcttctttccttcttaatttaatgtttatgtatgttcatttttccttcttaatttaatgtttatgtatgttcatttgcatgcctctattttttaatatgttagttttttttttttctgatcatcatcgttattcatttcactgaatactgtttatttagagagtaggaacccctttgtacgagttttcgataaatgatatgtttgtgtcagaacttcaataacatgcttgtatttgtttgaaaaattactattcagggtactagcaggcctacacactaccatgtactgttagacgagattggcttttcacctgatgatctacaggagcttgtgcattcattatcatatgtgtaagtagtagttgtgatctatttgattgttttagaatattgtttatgccaacccttgccatatatcgatattgtcttaaaatcattttgctatttgacaataggtatcagaggagcacaactgccatttctgtcggtaagttcttgcacaacatttttagcattgggtttacacttttatgttcccaatttatagaaatatatagggtctcattggtgaaaaaactggatgtatgcagttgctccaatatgctatgctcatctggctgcaacacagatgggtcagtttatgaaatttgaggacaaatctgagacatcttcaagtcatggtggttctggtatgcctgctcctcccgtccctcagttgccaagattgcaggataaggtttcgagctcaatgttcttttgttgaaggatctgttgcagttctagggataggcgatggactgataacagtgctgtttataagaccttcataggattttttttttttttttttgtggaaacagtttaactatgggcgccaatggtagtaggaaaggattattatacatgtaagaaggcattttgctcatgcctttacatgtgtttagtcttttactattttgaatattgttgcgaagtctttcgctattttgaagattgttaaggtttatgtgattcctatggtgttcctattatgcactcttgatcattatctaatctagttgtggtttgcatgaatcaaaaagatcaaatgggtattactgttcttgttaaagtttgtttgtgatctgtctgttatttacggataaaatccatattatcgactcctgatagcaatgtgacccgagttaataagaatctctcagttgtgttaaaaataggtatattttcattagcattttgagatcaatgctagttacgtgagtttaacttggttatttatttttccgcagttaagttattttcttttattctggtcgtttaaattacatagaaattggaacattcatgcagtatccacagaagaaaaaaaattgccttctatttgaaccgaatgagaaagttacagtatatagaagttttatacagtttgaccaatattctattattcagttcagtttagatttttgtgttattctttaggatatatatttctttttgtataaaacagttttattttttgttccatgatatttttttcatctttattcttcattctgctgataatctaaactgaaatattaagtttaattaaaaattaagttgactatttcaaattcttttttagaatatgaacatttttttaatagaaatttactttttttaattaacttttaaaggtacttgaatcaatatgatgtttctgccaaaaatatcaacatgacagttttttagaatatcaacatttttacatgttaaagttaatttgttcgtgctttttgtaagtaaaaattctgcaaaaaatatcaacattcatatgaaatttacatgtgttaagaggcaagctaatgctatggctcattctcggctaaagctaggtttccagtacattccatcgtgtattcttcactagcctattaatgaaatgcatgatttagttctcgtaaaaagtcaaaatcaatatgaatgttgtatatacctctttcatgatttcctattgacagatatgactgacattaattcttgaaaatgataaatatgggtagcatttaagaatcttaaaaatggagatagaatttttgcattttctctaatattttttaaagatcaattttaaaattactttgtgaacaataatttaacaatgcatgtatcatagagaaaaaaattgatgacgtgaagagttacattgacataaaataagttggatatactcaacctctaaaaatgaaaaaaaaaatatttaaaaaaatttaatttattttgtaaaaatttaaaagtaattccttattttttcttatttacctgtgtggtgcatctttccgtttcgttgaatcctgatccgtaaaaaaactaggctccataaaacttatcagattttgacaaacatggtgcatgagaccaataatcccttgacaacagcaccctataattctgcttgtgttaatatccctccaagagcaatgaacccataccagtgaccaatgtacactgtttcccgtgctgctcaaacgcccaccagctgtttgacctaagtccatgccaccagttacctcaagaaacctcatctaccagttgtgggaatattaagttgtactttacttgatttacagttagtgggggaccacatcagggccttgttttgttgatttgaacccttgcaaaaatgctcataagaaatttacattgtcacaaagtccattctctgagcctaaggtgctttacttctgcaactcctaatgtaattaagcctggggatgtcttgagaaaagcaagggtttatactgaggaagatgttctccaatactccaaggtgagttgtgattctaatcctttgcatactgattctgctgctgccaaagatgttggatttgaaggtccactggtacatgggatgcttgtggcttctctctttcctcatatcatctcatcacattttgtaagtttcatacttaccctctctttaaattttgatatgcctcctaaaatgagatagttaacgttctcatctcaatattaaattaatgtgaataaacagataaattagtagagttctattattagttttctagactgaattttatactctgtactctgtagcatacatttttacatgtaaaagttaatttgtttgtgctttttgtaagtgtgaaatttctgccacagtcagcagctttggggaactctaagttgattccgggtccaaatccccttgcccccatgaacatcctttctgtaaacttgagtattagacaccataatggaaaattatgacatgagatagagtatcataaaatgaagacggataagatgtgaaattgtaatctccactataaggagtgtgaaataaggtcaagtgacccctcacttattgcatagattaaaatgtgtcatgattaatcagaagtagaaagggagacacatgtaaaaagcttaaattttatagtatttcttaaagacatgaaaatataaacatggataaaggacttatcgtgtgtctggattggcgttatgtcagtgtgatccgcgtccttttgaattaaatttgtttagcttccacattaacttggcatacttgacgtgaatttggttttggatgtggttggaaaatgcaaatcaccaacatgctatcaagtggtcaatttaaatgctaacatgggttctagttctactgcttgaaaaattggtacttgtcattggatttggtcaacttgaataaaagacttgattttaaagtgcttgataaatgatgtgaattgaggcaatgctatgaagtcattcattgaaatattctcattctgtgataactttcttaaattcctcttcttccctggccacttcaatcttcaataattgcagcctggagctgtgtatgtatctcaaaacttgaattttaagttcccaatctatattggagatcagattattggtgaagtgcaagcaactaatctgagagaaaataaaaatcgatatctgtaagtttagtcctgctgttattattgtgcattcttttttaaacaaggagtaattttgtttctaaatgaatgtttctcaatgctattcagtgcaaagtttaagacaaggtgtttcaagaatgatgaccttcttgtgattgatggtgaggctgtggctttgttaccaaccttgactgtagaacagattcaacacgagaagccgtaaaagatattcactgttattgactgttaatcgcaaataccttttcaaaggcaatgttggtcataaaagtaatatgtttgttgttttctttctaatggaagtcattggggttctaaattctgatcccctaccctgaacacggacaaacagcagacaccaaaaaagtttttgttctcgttgttattctgatgttggtgctgaacagttatgcttgattttttgtgtgcttttttatcatatcacgcaaaagttcacttcattgcactgagcttcaaatcaaacggcacaaagagatcttattgatattttttttttgtcttttgtgccatctaatactattggttttggaggaaatgtttaatgtagtaacaagttagattttactttgtttcgtgcccatacggtttctctatattttgtattggcaactgcctcgcatgaaaccaaaaaatatggtcccttattaatcctgttgttcttccctctatagggttcatttaaatccaacatttgcagtagctatttacacaaaactaatggaaaatttgctttgttggtaaattttaagtaatagcacatgatccaaaattgttgatttgttaaaaacgaataaaaaaaaatttaaattagttcatgataaacaatctctcgtccctttttttcttttatctttttctcgagtaataatgtttggcattactattataatagtagtatgtgcgaataaattctttatttatttttgtgtacgatagcgggacaatgaaatttgaacttacaacttcatataaactatctaaaccacaccactaggccaaacaatttactagtaaatttaaaagataccttgaattccatagtttaacttaccatcacacaaagtaaaatcaatacaacaattacaactggtgcaatagtacatatggcctatcatttctagtaactggtgttatcagaagagatatcccacatcaagacaaagattaacaccaaaggtatttggttgacttgaatgccatctgaagcacaacaactttctggtgaaggtgctggagcaccacattctggtgaacttgctggagcaccaccttctggtgaaggtgctggagtgggtgcagcaacaccttcagtaacagatatagcaaccttcatcccatgccaacaatagcctccaccacttaagaagtagtaggtcttgaattcagttagatgaaacacgtctcttcttgcaccccttgatatgttatgaacaaatcctgtgtccatgcaattctcataactaagccttgctcacctctagtacactgtactcgttcctatcatatctaaagtcttgcaagcataacaacatctaagtcatagtcaaaagataaagtataataatctacagtaataaattaatctacaattatacgtgccctttttaatgactgactcctttttctcgcttctacattaataaatttagtaaataattaaaagatatttactaaatatattgttgtaattacgaattcaagaaattgccgcaaactaaaaaagcttagaaaaattgaaatataagataaatttaaagaaaaactaaaatattttaaaattaatttccttcaaatatattatttacttatttcaataatgttattctatttaatgtaatcataatataaaaaataatatttttaattttataaaatatattatttaaaaacatgttagacctcacaacaaactacataaccaaattggttagatttggttaatggcctattctaattaattgtgtactagtgatcatttgttaattgataaaatttaaaagtaatattttatattaaattactcaatttggttagataatcttgggtagattagttaggaaatccattaattaaaatgtatcattttgattctttatattttctaaatgtatcattttgattattttaaatttaaaaattaacgaaatattaacgttttaaatgaaaaattgaaagaatgatcaaaacaatatattttaaaaacataaaagaataaaataaaatttttaaaacttgatatatcaaagtaaaataattgtggaagataatgaactaaagaggaaaacgaaaaaacaacacgtgattgaaaataattatttttctgaaaactctctttaaaaaacagcaatagaaaagtaattccaaagaggaaacaagtgggttggttgtcagcggtgaacttagacatgcagtgggtgcacaccacaagcgcaatatcagaggaaggaagcatgcactgcatgcatgtacctacccttttcaattcaattatgcatcattctatcattctacgtctctctctctctctctctatatatatatatatatatatatatatatatatccacccttccaaacccactttgcaacatccatcaaagccttttctttcgttgctacttcttcactttcattctttgcttcagaaaattaacagtgttgaagagatccgtcaggcacaacgtgcagaaggccctgccactgtcatggctatcggcaccgccactcctcccaacttcattggatgcaaggcaagccatggtggttgtggaggtaccaaagttgggaaaagaggctgcaactaaggcgatcgatcaaggaatggggtcaacccaagtccaagactacccatctcatcttttgcaccaccagcggtgtcgacatgcctagctttacatgatgtaccaacaaggctattgtttggatatggtgcaccatccttccatacagtgaaggggctattgatggccaccttcgccaagttggactcactttccatcccctcaaggatgttcctggactcatctctaagaatatcgaaaaggcactagtgtaagcctgaaaaaatggaagctactagacatttgctcagcgagtatgcatggtaatatgtcaagtgcatgtgtgctattcatcttggatcagatgaggaagaagtctttaaaatttattataaaaaatacaagtttacttttccttttaagaatgaaattgattgtaatattattactaaaagttggtcacgacctgcacatcaaagtcaataaaagaaagtaattgatgagaaaattccaatatctaatccatgtacaaatatcaaaatccctaattacttgataagttcactactcttacaccttacaccagaccacaacctatgctaggattaaagaatcatactacggtgaaaatattacagatagtacagcttccagcaagccttgtattccaatgtggtcatcaccatattcaaatccactaagttgaagagtcgggctgtttgatggattcacgtgtaatatttgttgattttcatgaacttgttgatatgcagaatcaaatccactcatttgatgagtcatgctatttggtggattcagtggcaacatttgttgtttttgttgcatttcctgaacttgttgaattccagtaagaggaattgaattttgtggatcaatgatgtaaggaactccatttgtgtaatgtaattttatatcatgaatgctttttctttttttctgtatgggtgaggcattttggcgaatgaaatacttttgggcatgactggcaatttgagtaggggatcttgttttaaccaaccttgatatttctatccagtttcccttcccatgtttttggagtccaagtaaaaacaacctgccattaaaaaacaaatatgagacgaaaaattgagaaactnnnnnnnnnntggtgaaggtgctggagtgggtgcagcaacaccttcagtaacagatatagcaaccttcatcccatgccaacaatagcctccaccacttaagaagtagtaggtcttgaattcagttagatgaaacacgtctcttcttgcaccccttgatatgttatgaacaaatcctgtgtccatgcaattctcataactaagccttgctcacctctagtacactgtactcgttcctatcatatctaaagtcttgcaagcataacaacatctaagtcatagtcaaaagataaagtataataatctacagtaataaattaatctacaattatacgtgccctttttaatgactgactcctttttctcgcttctacattaataaatttagtaaataattaaaagatatttactaaatatattgttgtaattacgaattcaagaaattgccgcaaactaaaaaagcttagaaaaattgaaatataagataaatttaaagaaaaactaaaatattttaaaattaatttccttcaaatatattatttacttatttcaataatgttattctatttaatgtaatcataatataaaaaataatatttttaattttataaaatatattatttaaaaacatgttagacctcacaacaaactacataaccaaattggttagatttggttaatggcctattctaattaattgtgtactagtgatcatttgttaattgataaaatttaaaagtaatattttatattaaattactcaatttggttagataatcttgggtagattagttaggaaatccattaattaaaatgtatcattttgattctttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcggtgtctggtggtgttgggtgtcctccgcaactagggttgcaacgttcagcggtgtccggtggtgttgggtgtcctctgcaaccagggtagcaacgtttagcggtgtctggtggtgttgggtgtcctccgcaacctgggtagcaacgtgcagcggtgtgtggtggtgttgggtgtcctccgcaactagggttgcaacgttcagcggtgtgtggtggtgttgggtgtcctccgccataggaatctgggtagcaaagttcagcgtcgaccatatatcatcgcaatcaaaaagcagattgtagtcataaacatcatcattccaatcgttattatataactcagacattgttttcttcttttatggctttcaaagtttgaagcttcaaactcaaattgcctttctttccgttcacagggcttcttatttaacaaagcatgacgcgctaaaatttggcgcccaagtgacactcattattctttaaaatttgaatttttttttttttctttcaaagttgcttatccaaatatttcaaaattgttaatcataataaatttacttatccaaataaatgagaaattatagtaatacatttttaaaaaagttattttaaacacaatatttattattagttaaaatttattagaggtcacaaattttatgatcctacttctcatttaaaaactttttttcaattttatagtttttaataaatttgaactaatattacttatgtgttataaatagtgtgttagggagtatattattaacatttctctaaataatatacataatatattattatataaattttatcatcatcttttcaaattatatgtttattaatttattaaagtttaaatttacataattatattaattaacttatttataagtaatttcataattttatttgttaatattatcactaaaaagtgagattttaaataattttttaagaagtataagacttaaactaaattttaaaataatttatataatataattaaactaaaattaactcttatatttcaattaacagattagtcacaaatctttcaaaatcgagtcgaccaaagttgatttcctttctacccttacactgttatttaaataaacgcactgcatttgtcaatattcacctatttttatttgaaaatctcaaagttgacaaaaaaaaaatagatttaaacaaattaaaatatttcaaatgattgaatacaataagattttttagatatttcaaaatttatcaatccaaaaaaattagattgatttaattaagtaatttgattgattttttaatttttaaacaaaatatattttagaatttatttaaaagataaatgaaatattaaaaagtcaccaatattactaaaaaatagagagggaaaaacatgatttggtattaggcatgacagcggaatctgaccccgtggggatcgaatcgaactctccccccgactttgacggggaaaaataaagtcgaccgggttcggggtcggggtcggattttccctattaattaaaactgggggggtatgagataactgatatctgccctgaactcaccccgtaataaataacattaaaaaaattatatttaagttgtttctttttttattatgtatttgaaggatgtgatacttaatcatatgatgtggtacttaatttttggacaatatatatttaaatgatatcgtattttgtgagaaattaaatatgcatgtccttattttatgcaataactatattttatgattttaattaaattaattgatttggttttgtaatttttaattatgatctcattctcatattttgaatgtgaattttttattatttttttgttatgtaactagcatttttggcccatttttcaataacaaaagttatattatttttctaatttttttaattttaattaattagagagggcggatcgagacaggaaaatcgaccccatctgggatggggtatatatttttaatctcaatagggatcggagagcggttttagaatagagggcgggaatggggaatgaaaaacccgtcctgtctcgttgtcattcctagtaaaaatgataaattagataatagcatttttttctaaacaacaaaaagatgattttttaaattgaatgaaagagtaaaaccgaatgtcaaataaaataataaggataaaattaagagagaaaaattaaactataagctaatttattttttataaactacttcaaataatttatgaaaataagtcactaaaataaacttgtgtagcaaagtagtttataagataattaccaaatcaaagaaacttaagtattaattacaaaagaaaaaatactcaaaatagcctatattattgtgtatcaatatttttagaacataaaaagtaatttattgaaacagaattcaataacatcaaattatcttaaaatgtatctaataatatattgttataattaagaattcaaatttgacctcaaattaaaatgttaagaaaattctgaaatataaaaatttaaaaatatataaaaaattatttaaatatatgattttctcatttcaatgatgttcttgtattttgtgcaatcagaaattttcaaaataatgattttgttttaaaaagagcacacaataaattaagaaacaagaatacttgatatagggtaataagcgcatctccaattattcatctttatcctcaccgttcataaaatttggaaactggcatgttttcattggctgtgatgctgctaaactggcttgacaaccaccaaaactatgttttcagcttttaaactcgattccattacttgaacattaaataattttttggttctgtcatgaatatctccatttcagtgactaattttacttgctataaacattaactaatatttttttatcaagaaatatcaaataattttttttttctcttgtcttatttcttctttttcttagattttttttttttttaactttttcatatctaatattgaattcatctaccaccgactccaattaacttaggttaaatgtgatgttgatgatgatgaagaaacatcaaataatttaaattcactttatttgacacagcatataattgtttgtaccttgccttttatctttttcacagacaatcattccaaaaatactctcccaaaattaaaggagacaacttgtcccattttagttgtaccaaaaacattttgctttttaaaccataccaataacaatttggtaagacaataattgttacatataaattaaatgagcacgccaagttacaaagtaagaagattctcactcttattgttcaaatttggcaaagatataagtacaaccctttccccccttttaacccccaccaaaaataaaaacaagaacctctttttcttatgctgtaatgtcacaacttctagtctatcatcttatgtacaacatttggagagaagaaaatgtgtctctcaaagtttgcaagatccaccaaagaaaggatgcagtggtattataccatatagaatgatccatcaaagaaacctgaaaagacttggctatcagcaatcctcttgatgaggcataatcaactcaaccaaatatagagaagaaacaaacaatcttctttcaaaaagtaggccgctactccacaacaactcattgttatgttgttaagagttctcatcaaaattggggatgccatcaaaactctgccatatgtatttaccatttggacatatcactcaacttaattgacatcctcttttaccatactcttttctttggcacggaaatgctccaaactaggatactcttctcgaagcaacctgtccagttcagggtgttgattcaatggttctttttggccacggaccttgcggtaatgatgaaatgccctgccaatgccataaatataaatataaatatgtaagaacaaaagttctagagagtgataatatggtgaagaggagtgccaaaacaatagaagaaaactacatttctctatatctaacagatatgagggagacagtgccttgccttagaatatggcaacctccattcacccaaaaatatagaaatgcaatactaataaaatagtatgctagcatttgacatagaaactaacatatttgcaatatgatgatctattttggattagctaagcataggtaatctagtgttataacatgcacattcataacatttagaactgctcatactgttccacaaatctaccatcaagaataaataaaatgctccatttcagtccaataatgcagtcaggaactatgttataaagattttgtgacacaaacaggaaataatcaaatataactaaggtactgtataattagatttcatagaccagtgaacaatctttttaatctagaatacaacttaggttatacactaaccaaccaatatgtttacttctttcactataacaaatctcacatgaaattgggaaaaggaatgaaactacaaaacagaaaatatgcagtagaatataagaagtaagagaatttggttttttaccaatatttttccaggccatacagattgcccttatggtagaaatccagagtgagttgttcaaaatcattgtataaatcatctctaaattccttctccaatccataactgcgcaagaaatcattcaaaaattagaagaactatgcttggatgtcttctaaggaaaaataaaaataaaaatagacaacataaagcaatttaatcagcttctccaaagaaacaatagatgaaaattcagaagacttgaaattagcctattactttactcgacaaaatggaccagaagatgaaatctaaatgatggttctatcttctcaaacaaatgagaaaagaaaaatttggaattggtacctgtaaaatctgaaaaggcactctataccataattataattagccgcagcatcttccttagctaatttcttaaattcattatacatagaaggcacaaacatgtctcgaagaaaataggaccagaatctgtataatgtattcatttcctgcattgacacacaaaaggaggagaaagaaaaacctaccagaataagcaagtgtatgattgaaaaagaatataatacaagaaaataaaaatattaaatttgcaaataatatgaaaaccgaaatgtataaaaaaatatgaatgcataatatacaaagtgagctaatgaagatgacagcactgcatccaggctcattttgatatgaaagcttcggctaatgacattgttaagttaaaaagagaaagttgaccaatgcaaaccaatattgaaaatgccacatgtcataactattccacaattttcactcgaactattgcaacatactcgtacacaaagtattttagaagataagtcattcaattaacaaattaagtaataaaaaaggcaggcaatatattaaaagtaacaggaacagaaattgagactgagttcaatcggtgggctaccaacgtggttctttacaaatatttttcatagaaacgtaagaaatggagttcacctcgctgcaaccaattccaagtttctttctatcattcaggcaccgtttgtgatacttcaagtacctgaaaggaagaatactaacatgaggaatttttaaaaagcaaatcctatagggctatatcctagtaccactctcatgcatacaaccagtaagcattatcatttacttctgttgtttgaaaccgttttcttctaaaagttggtgacttggatgctgaaacggtggaaaagacgttggcattgaacccacaggcggactaccagcgaaacccccatgtggactaccagaaaaccccccatggggactactagaaagacccccatgtggtgaactactcaatttggaaggcttgaaactgcaaatttaagataattaatggaaatagcttcagttgtcaaaccaaacaatcaacatgtcatatcatactctctgaaacagtaataatttatattcttaatttaacaaattatttactatatattcttccagtaaagggtaaaagtgaaaaaaaaaaggctggctaagcaaaccaatattacagtcatgagcactgggaacaatcattttgaactgacccatgattttcaggaggcgtagaagcaaagaaaaacccaaccgaattactaggcgggctttcagatatgattccatgagagtttcgaccagttccatgatttctaaaattacttgagaaaaaccgctgcttaagggaagatggttgcttgtgaaaaactttttgtttccttcgagaattatagcttccagactcttcaacactgtttccaccaatattctcaactgcctttatatttgatgcactcgaattatggcttggagattttatgtttcgatctctgctatcagagttattctttctacgattagaccgcctatgtttcagttcctgtagataatgggtggggcaaccaaaaatttaataaagatgatgatctgaaaaataaaagacaacaggggaaataagaatagtgactcaacctgctcgtagaagtaaagaccatcatttattgcggaagcaagctcattggaaatggatattgattctttactaccacctctagatctttgtttaggatcaccattctgtacattagaacgtagttattagaatcttacaattcatgatttgaatcctacgttcaatacgatacatctatctatagattgtatcataagatgaatctcatttcattctttttttctttacctttcttttacctattcacgtgaaagaaattgtgaagtcatataagcttaaattgttaaatggaaaggaatatcatgagcacttacaaacttatcctatttgattattgcacttattttatttgtcattcattcaatgcatgcactctatttggctatttcattgctttgttttcattcttctaaaaatagtaacttcacaaactaattttgttttataagatgtttgattaagtcgtttttatctattttaagtttaaactattacattaagttatttttcattgtctctgaatccgatttgatgcaaataatgattcacgatttgaacctaaatttgataaccttgcattaaaatataaaattattaaataatcaattaattgtaattaacattctaacatattatggttaaatcagttttcgttcaaaaaaaaaaaaaagacattacatagccgtatagttataacttataattaagtagtatacagagcaatatagttatgtagttcccgcctctgaacatccataaatcagaagaccctcaaattattttaattttcatcaccattgctgtttgggcaatatgaatgtaaaattgaaacctaatttgaatgataccactttagaggaaagaataaacatatgaacttgattttaattaaattataaacagcaatacctgggtgacaattactagtctctgaacatcctgttcaatgacagccatctcatcatcttcatcatcattccttttagacaacaacttccatcagatgaatatttgaacaaaaaagtgaacatatgatatgcttaatgaaatggcacaaaaatcacctaatatcattccatatgggatgcctaaaataaagacaagtattctaacatctcaaacagaatactaacacagttttaacaaggaggaaaagaggaacctttgaatttcacattatgaagaaatcaatagttgtcttttattaacttcgaagaaaattgtggaaaatatataaaggaacacaatgaagccaagtgccaatttataaatgaaacacttgctgatattccactagatatcaataagataagacattgctgagcaaaaaaaaaaatcaataagataagacagaactacgaagtaccttccactagaagaaagttcagtcttccttagcatcttttgctcaagctctatctcttcatcgagcataaaagtattgccaaaatcattggaaaggtctcgaacatccatttcagtcaagacatccatgtttccagcctcattattgtcaaatactttgggctcagtttcttgttggctacataaattattattagttgtttcaacatcacagaatttgacaccttcatgtgatttatcattataacgatggctctcattatttttttcttggttcatatgtgaaacttgtaacatatctttgtttggctgattatggtctgcgaaaattgagtcatgaacagcatctttaggattttcttcggaagtctccttcgtcttatctccaacagcatcaatattctcaagagaattgacagcaccatctacaagttggccctgttgaatctgagctgttggtgatcctgaatttcctgaggaaactcgaatccattttgaccaactatcacgttgccttattttatcaccctataaaaataaggcaagttacaagtgaaggcaacgaagaaaatgaaagaacacaaaaaaaaaatcaagtagttggaaaagtagcttcaaactttcatgcacttaaagctggctcctatagaactaaaagtgttattctatatataataaatatactacgtatgaaagcaggaagttctaactattagtatctataagctaacaatcataaccatcttcaactccataattcatctatacttcagccataacaaaatctgctttaaactttaaaaagccaaaacaaagatgccctcttgaataacagtaatgaactcgcactatgtaattctcataactcataagctcaacacatctatactacagatgatacaaatgtgatgaacttaaaagaattattctatacttaataaggaaacttaatgcatagttatcaatttcagatagctgtgcatgtcatctaaccctgaaaatttctatagcggtatagcaagaagctagacaaccactattttaaatattaattacaaactaaatttatactgcagataactcaaaaaacaaaacaaatgccaacattaaagaaattcatgataaataataggtcacattttacacacacaatcaccatcaatcttggagcaataagaacatagtaataaagtcaaaaaatgaaagatgatgatgaaattaatatgaaaaaaaaaacataataaattagatagaaaaaatattagcagaatgtgaattgggaagactaaaggaagaagaatcacagaacacgggataaaaaatagtcctagaatgtgtgaaggaatagaggtcaaaacagaggtaactttttgtggaatattttaaccaaaaaaaattatgttccagggataaaaatggtttttttaagtatatatcatggtagcgcggtgatagcatgcaaaaagctgctattgtagacactattgaaaaccactccacttcactatcctgctatagcacgctattgactactaagactcaatgtagacaatatttcaaaactgagttccttttgaaatatagtgaaacagttaaatatgcctattagagggtgagccttggcacaacggtaaggttgttgttatcttgtgatcaaaagtcacaagttcaaaccaaagaatcagcctccctgctagagcaagataaagaaaaaatagagactgaattatctgaattccaaaatcattgttgatattatggaatacaaaacacaagaatttgaattttaataaaggtcttgacaatataatttttgaaaaatcatcaataggatataaatgtgttgcattaaacttctcacaaacatgaaattgcatcccattactctaaaaatatttttaaaaaatattcatgtacaattcatgacataaacatttgaaactaccaacccccaagcccaagattaatatcagagataaacaagaaaaatataaaccaccagtattcagcttaggggcgaaagtattttatgcaacaaactagattctagagttaatgagaaccttagccctgtctacacctgcaagcatgcagtaaatagtaaataactaaaccaagaaaagaaaaattgcctgaacttccacagtattagagctctcaagtgcatcaaggataaaaggtatgtctgtgctcatcttcttgacctacaagataattcacatcatataaggcaagtgagaaacagggactaacatggaactcaccaacagaaaacatctgcaaaattataatacatttgggaggaaaaaaatgctttggacacatacccttttaaaatcagcaacagtggatatgggaacccatccttggtcatccatcaaggaaataaggtaatggtcattctgcagattttcatcactgccaaaagaaggctctgaagtcagcagttgttgtaaagattatctttattttcacagaaaatggaatcaacagaaattattactggacttcctaagaaaattctaatgttcattagcttgttcctgttgctttaacaatctgaagcccaaacactacaaatcagttccacttcatcatctctggcaacaatcctatccaaaggctaaatttatgcaattatcctaatctaaaaggaatagtacagcactttgcaataacaatatacataataacagtatattgtcactcaatcgaaagttggaaacatcattctcacaatatagattagcagatgtcagattaaaaaaaaaaaaacagattaagatcaaatatgatatagaagccagggtcaacaatgaaattacttacctaaaataatagtctatctgttttacaatactagtcctcaacgatacagtttctggaggcggtggctgaggtgtggggttgacaggatatgggacaaagtgcctaggatggggtcctctaatggagccaggaggtggcatggggacacaccaaacgggtgcaggtcctatccaaaagataaaaattggattacaaaactaactgatggagaaattaaaaaataaaaatatcagagaaaaatcctcacacagctttcaagttgagaaatccacaagtgactggacacaagaggaagcatagatgtatgtgtgtgactatgtaattgcacaactatgtgcataaattagaggactatgaattggaattttacctgggaagcttggaccaaccatgtaccctggaggtggaccataaaatggaggtcgtataaatggccttgggcccaaaccatgttgcataggaatgtttgctctggaaggaaaaggtctttgatgatgccaagcatgattgagatggtcaccttgttcttgcatatttggtcttccattagaaaaattgccaacataggcatttggatcttcctgcaccggaggctgaacatttttgccatcaacagcatgagcaggtggagcaaaagcttgtccgggcgcctgagaaacaggcttcactaaagggttttctgcacccggaaaaggtcctggaccaggtgggaaagcataaccaggaacagccatgtgcggaggcggtaccataggatgaaaaaatggaggaactggttgatgatagtgaattggtacagggaagggaggtgcaccatttgagttacgcttagcacctggcttttgatggcgtgataatggcagcttatgcattgggttaacgtttccagcaccattcaccttcttttgaaaaacaaaccgatgcacgcacaaacaagaaaagatattcaataccaaaaaaggagaactttgttgcattgcatacaactattatttctaccacaaaatcaaaagcatagatgaggaaaaaacaataagcacctaacatatttgtaaaaccataagaacacaatgaaatctactccttatttacataccatctaatgttaatcagtaaccacaattgtcatgcttgcaatattcaggcttaaatcatgaaaatcgtaacaagacataaatgtccatcctaaacaaataaactttgttacaatacaagacgacaaaaacatagatacaaactcaagaacatattacatttccataaatctatgcattacattttccatatcacaatcacaatggtactacacaaagaacatactaacctgcataaaacgaggtctgggagcaatctcaccagagcttgtcacagaagcagcagcagcagcagtctcaagattcttgggtggtctctgtgcatcagagagacgtggccaagactcggtgcccatcatcacagacacatcacctcccttcccatcaacagtaggggtcttccatggagacttaggagcagcaatctccttctgatcctcaccaatctcattctcagcagtcaccataactgctttttttttctctcaccaatccacccaactcccaagatttccacctctaaaccccacttgccaataaacacaacactcaacctaatgggtgctcagagattcaccaaaaacttaaagataccacaagaagattgaaactttacttgccatttgaatcagtgatattgagcacaagaaccctgagctgaacaggcgataatttcatgtgggtgtgctaaaaagggttcctcttgtgaagttttaatgaaaggagttgggtcagtgtgacaacagaagaaaagtgaaagattagggttttggacagtgaggtgatggaatgttatgagtgtgtttggagacagtagcaatgttaacaaacgccaacaaagtgcgagggtaactgatgaaaaggcgactgagggacaaggtttttgactttgtgaatgctcctatttataagaccatatacggatccagaaatttattaaaggatgagctaaaaaaaattctctctctatgcaattatttaaatgtttaacttttaataagtaataatttttttaatattttactatttttactcataacatagaaataattttaaatttaaatgataataatcttaacctctatcataaaaataataaataaataaatagttttacataattttattttaattatcattttaaccattatagtaataataacaacaaacacaattaattttacattaacaaattttataataataacaacatggataattgattttatatagtttacattaattaatttaaatagatatatatatatatatatatgtaagaaatactaaatgaatggggctcaagctcttgcctctatccctctccattcctcattgtataagacattctttaaaaatttatttatgctgcatacttgtttttatttattttctctcccaacattaataagaagtaattaaatgaataaatagataagaaaaagttaattttgtaataattatacagataatttacaggtttgatatgattatgtaaatttcattaagaaaaacgtgaattagttttgaaaaaatctagaattaagaacggagggattatataggaaagatagttttaccccatgaaatatttattctactactatctgaagcaccaaatatagaaatgaattctaaaaatattagaactatgaatcacatacatcactcaacattcccaattggttgtttctttgcgccatttggaaccagccaaaaagtgcccccaccaactttaatatcatataattaatgtagtacttaaatagtatttgacaatttttctttagaaaagataatgttgtttaggaaagtaaacgatataggagtagattaaaaacataaacagttgagttctatggtgaaggttgaaaacctgtgtttaaatgaatgtgatgtaggtgtatttttcttcttcttcttcttctagttttgaggttccgaaactaatttattattttacagcttttcattgtgggttctttattttgggtacatggggggagggtgggggacgagacttaatgccaaaacaaacgcgctttgaataagttggaaatttatttttgtattgtatttgtacgaatgcttttaattttaaataaatgtaaaaaaaaaatataaaagtatcatctacttcccataccaattgaagtacaacactaaaaaaaataacgactgtgtttttaaaaaaaaaaatctaattttattagttttgaagtgtatatgaaagcttacagacttttttaaaattagtttaaaaatatatctatataataataacaacaaaggggtacaataatgaattaatgataataagaagaaggatgaaaatggtgatagtgagaaagtggacttaaaaatgacagtggggaagttaatcgggccactcaatccgtaattcgataggccaccggcaaggttgtctcgttcggacgctatgaatttacagaaaaaatgtgtaaaatgttattagatatatgaatatgattggcaattataaagttatggtctcaatatggttggtaattcacttattcaaaatataaatcaaatacaaaattattatttttgttagtttattttataaactcaatttctgtaatactagtaaaataaaatattttcaaatcaactttaggttgagttattgatataaaactataggttcgttaactaaatttgtaaacttatattaaaatcttaaacattttttattttcttctctcggtcaactcacccttaagtagcactatgctgattttcaacaaaaccctccccagccatcttttggcaagattatgatgtggcgggatacatcagactagttcatttgtcattagtaagaattgagatgtttaaatttaaatcgatcttaaatgaaaattaaaaattaaacaatattaattcttttttttatttatttggatatttttttaaaaagttgattagtttggtttgatttacaatatgtttagtttaaaataaatgaaaatttgatctatttttatgttaaaaggtttaatatattaataagtttcataaattatcattaataaattttttaatatcttaatttaaaatataaaaaataaagtatataaattttaatgaaataatattttaataaaaattataaaaaccaaaataaatcaaattatcaaatattaattttattttattcaaattttattttaaataaaaatcgaaccaaatcaaaatggaaacagccctggtcatccctaacagcgttattcaatgataatgataagtgctggtgtttttttattccttcttgtttttattcaaaattataatagaaaagaacaaaaggtaaaccaatcaaattgtcgtaggaggtacaaattttcaagtgatttaatagaccgtagcatataaatatgacaattacaatactcactagctgttgccttcattaatgtgattggtcacttgttttagttttattaaaatgcaataaataattttaagattattgaatttttataataattaatactcgtctttgatattttaccagctagtgacaaaattatcattttacaaactgtccattgcatactttttttatacaaaatctaccctcccttgcttccaaaaatttccattttccattttgtcactttgtaaaagatggaaaatcagcttgaggatacaaacatgaatttgaataaaggatgaaaaaatggagccaaactttatgggtaaaagtatccacaaaaagagaagataattattcatttattaagattaaggataaaaacgagtatttacttgtactttttgcggaatttgattatcactaatttaccaaaattcccagtaggaattatgggaatataaagcatttctcatgctatgcggtccaccatgaccaaccaccaaagtatacagatcacgttggaccagctcaaaatgaaactattacatgctcgtccataaaataaacatttctgtctaattatttggtccacgtaaactagcaccgtaaatccgtcgtgagaaaggcaaatcttagcatagagaaaattgaatttaaacccccgtaaccccgttacccttttccaatttcgttgacaagtttttataacacaaacaaagcacttaaacaaaaaacgggggtaattatttaactacaggttcttccagtaaaagtttcgggggtcaagtgttggaagaaacctaaaatttctaaatcaatgtaacacctcgcccaagatcaaccagctcaaatttattgaagctccaacaaaaatgtaacaagacaaagttaagtattcttttggaatattatcagtaatcttcttaatcaccatatcctcaagccaatatataatatcttgatgttcgagagccagatttgcagttcacgcatgtgccaactgccttctcaagctgtgtgatcaatatcagtaggatcttcattataacatccagaatgttaaatagccatcaaaaaaattagtccttgtgagtaaattatgcattttcagtctcacgcaaataaaaacatgaagaaaacattacactttcttagactacagcttttgcccagtttggtattgccttcataagcccttaaaaaagataactgtcttggacaagattttcaaaaacatttttggcaaagcaacttattttggtatgttaagttttataaaatacttcttttgcagctttaccagatattaactttcaccaaagacagcaatatcaaaatggacctttctccaagaaagattgtacgtaaaaaaaacaaattgaactcccaagcgaaatccagaagcccaacttgctaatatattagaattaaaatatcttcagaaattagttaaaagctccagaaagtgaaaagtaggcaagtttccgaagattaactttcccagacaataacaaaagaaaagatcatacccatggataactgcaaagatgataacaccatcgcacccatctgatcttctctctgacattcactccaaaccagggtacacttgtatatagtgagagccaaccctcccaccaagtgtggacatttctttgccttagaagtgaatggaaagacccaagctccattagtggatgcagatgacagaagttatgaacatattcaagcttgtttggtagcaaagacctatgtgtctagataagttgccaacaaagttaaacataacatctccactaattaaaaaaaaacatgtagaaactaggaaaacaagctaactgacacccaaagaactgagtgcttattttcagaacggagtaaaaagatgaccaaagtcaggtaacaattcatttcaataactgttcaatctttcattcaggaaggagaaagaaaaaatgattttctcgaacaagatccttgaatatagaggagacaagcgagtgaaaggatgatggaaagacaaattatgacaaaagataatccttgtttaatgttgttcctcatcatacttcatttcactttcaatctcccagccaaaaaattcaatggaaggaaaaaatggttcgcaaaagggatccagaagaaataattgatattcaaatgttacacggaattaataagtaaatagtagtcattacctataaccataaaaaatgactacaacagtagtcctcaaatccccaaagtatattcccatttttggataagaacattatacttatgaaaaagatggtagtagccctcaaaaatcaaggctgaatgccagacacacgtaaaacatgtaaattatactcgagtcagttatgctttgggaagctaaataaaacagaattggacgttcataaggaaaaataatggtccacaacacacttaaaaaattattatcataaagttttctcttccccaaaattcacccgttcctcaatagtccataaaggaatacgaggtataacaagattttaaaaacatgtcaggggggaaatctactaagataaggggggaaaatacaagtttcagaatctggttctttagtaatcaaatagtaactaaaattacagattaaaagatgcatttgaatagtgcctggtacttcagaagaatcagcagagtccaaaactaaatgattgatgcatcttatgagggtatctgcacagtgaatacatagagtaaaaaaactaatttcacaaaaccaagtgcctatagaagaaacacaaatacaaaaatgaacttttaaaaggccatacctctggtactgcaaaatagatttttcaagagttattataatgttcaaatttgaactacaatcccagtcaaggtaattgtttatgcaatacaaaatcaatattgacagcaaatggtagaagtgttaaacacaagcctaggaatgttaacacacagactatgaatagatcaagaaacttgatggaaatagagctcagagaaaatacaacaaatagttattcataaatcataaccgtagctaaaacagctaagactgagcagtcatcataaagtagcatcactatctatataaaacaagaaaggcacacatgtgagaaacagattaccaaactagacattaacattataactgcaaaacaaaatatggaaagcataatttcatcaggtccaatgcaaccaaacacaattagtatgccacttgggctcatccatgagtgaaagaagcctgactgaatcatgcaattagttaactaattttaatactcgtgttagtacacatcaatatcctcagcttcgtgtaattcattatttaccaacaaggggcattcaaagatagggcagcctatggattaacaacaaacaaaaattcacgagccactcacctaatgacccatgtaaggagcaccagcaccaggatgaggtctcacaccactgctctgtcccatttgaggattctggtatccgggttgcattgctggctggttcccataccccatagcaggctgatttgcatacggagcaggcggtcccgcctggttaaccggggcaccgccaagccctccaagcagattcccaagccccaatccagctccctggttaatcaacgcagtcaacgcctgtccaagtgctggattcaacccctgtgccggcacaccagggttgaaaccccccacagcagagcccgagggcgccatcaaatgaccacttccaagcgatggtccaccaccgccagaggaatacttgttcttctccttcctctgataatgaggctgatgatggtggtggtgatgatgagaatgagaatgctgctgatgatgataccccttgctccccttaggaccatcaacagccttctgacaatacaaagtatgcccctcatagttcttatgaggctcttccaaagccttcttagcactgtccacagacttatacacaaaaagcgcaaaacccttaggtttcccagtgttcttatccaaaccaagaggaccatcctcaacctccccaaactgtttgaagaattcaagcagcttctgaggatcgatctcaggattcacattgctcacaaaaatcttcctttgggtgtactcagacaccggggtaacattcggcggtggagccggaacggggccggcagaggccagctggcacgaagtggtgcggtttccgatcttcttttgagggtgtttcagcgccttgcgagcatcgtccctgtgcttaaagaggataaaagcgtaaccctttgatttgccggagaccttgtccgtgacggccttgcagtcctcgatctcgccgtatttcccgaacacggcggttagagtatcggcggtggcgtcccagccaaggccgtggacgaagattttcctgtgcgcggggtccacgtcagcaagccggcgcacgctatcggcgaattcggggaacatatccacggcctgcgtgacgagagagtggagctgctcctttgtgaacggttccagaagcttctccacgggctcttgttcgagagtgagatcctcctcttcctcttcttcgttgtttccttcattgctgccattcgcttcggcgtggtttgcagccgctagggtttctggatcctgttgctcttctagagtctctggttgccgctcctcttgttgttcctctgcttcctcttcctcttcctcttcctcttcttcgctttcggcgttttgcggttcttcttcttcttcttcctgttttggttcgtcgacggccatcgtgttgggatcttctagggttggttcggggttgggttgttgttgttgttgttggtcgagttcaactggctcttggtcctgttgctgtggctcgacaggtttggtgggttcggggtcggaggatcgaagctttcgtttcttagccatggcggcgaggaggtagggttagggtttcgggaattgggggtgttttgactttaatttgatttgcctgaagaaagaagaaagaagaaagcgagatacgattgcgctctcagtgggatgtgaaatagtagtctatttcaccgacgctgtccggttatttctcagtcagtgtaaatggaccgggccgggccggatctctacttctccaacatgtaatatgttgcaatttgcaaaagatcttaggagagtttttcttttttctttttatttagcaaattacattaatacttcctcacattttttttagattagacaaaataccatctttgattaacatttacaagctttgcttattggattatacgttatactaatgtttcttatttgtatctccaattattagaaattaatcaccattacaccattttatttttgcatttatatttttataaaataatcattaagtaaaaaaaaatgcacatagttaacttccgtatctagtccacgcacaaaggttattgtactggtataatatataaggggatgttaatttttttgaacattaaaatttaaaagtattggtgtaggaatagaaagaaaagaaaaagtagtatcctgtccaattcaagaaaaactcaagaggtaagtgtaattttttaaaatatgtgttgataatttagctttaacttttatttaaaaaaaattgttcttgtatgtatttaatgaatgattggatttcatttgtcacacgagtaattacattaggacaaatttattaggatgattaatattttttttataatcattggtttttaatgtataatagctcctagatatttttatttaaatttaatttatacaatatttatataaactatgtttattttattttttatattcaagcatccttattttttcaattaaaagatataaaattatatttttaaattattatatattctatttatgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatttaaaatataatttgcaacaaattttttaatatataaataagacatgactttatctttcaataaaattaattataagtttaacttgactctttaaataaattaacatgattaaaattttaaaaaaggcaaaaaaatataagattttaatatattataacaaatttaatataataataatattaacttatgaattttttaatacgttaatctgttttgcttaaaagacatataatctaatatgtttaattaaataaactttattataagctttgacctgatttatttttttaaaaagtatgatccaatttaagtacaatgaattaaattaaattaaacagacttagacttgttaattgtgacttgttactcacatcatcaaatgcttatatgaagattaataacgtaatcccatccgccaatacacaccaaagaaacaaataaagaatattcttacatcataatgatactaatctcgctacaagtatcagaattgtccccttctcataataaacgacccttcacattgtaaggatttgtcatatgctttattcatttttgcatacgaaaaacaacatttcaagtaactaaagacatcattatctttcttaaacaagttgattgataagtaatacatgtgttccttgatcattatattttggtttgctagatcctattgggatgcccgacaaaacttgttccctttccatttgaatatgttgaaatagttatttgattttgttcatttattcacccataaatttatacctcacttttcagcctaaatttgaggatacatgtatggttaaatagtaatataagaaaatttatatcatcatcaatttattatatatatatatatatatattatttattttatataaataccttagaacatctataatacacaattagataaattatctattctattttgtggatcttaccgtctcatataaacttaaacattttaacaaaaaattacttctatattaaaattgttaaagtgagtattttacttaatttgtaaatcattccgtgcttgaaacatatgtgatttataatataaatgttgttaaccaactacatgttatatatcccatgagaagaagaaaagctaaataatattgcttaaaaatgtataaaatagttatctgttatttctcaccagacatgttcttggtctatgtaaagttgttcaacgttctctgttaccaagaatcacacctgaacataataataatcgaatgcgaaatagcatttttccaaaagggagaaactctgtttgtctttaataagattatccatacgagttctaatttagaaagtggagtttggtaattggggagcattgcttttcctttttatttatttttatctattttttcacaatgagagagaagagagagaatcttatccgaatcccttgtacgtcacgtgacaatcatagccctttggacaaaaccaaacgagaggcccctttacacgtgtgtcctcgttgccacgtacgaaacctctctcctcagtcctcagcacgctactccacgcgcccactgctgtgcctcttcttcccttgctcttgcgccaattttattttacttttttataaaaaaaattagataaacattccttttgctatttttatcactatataaaatttcacatgaatctccataaataatttaaacctgattctataagtgaaatccacgtaataacttcttatataaaacttatttggatgtaaaattaaaaatatttttgagtattttttattaaaaaaatactatatttataataaaaacactcttaaaacattttaatttatatctaaacaggctcatacccaaatgcatcaaattctgttggtcaatatgagaaaaactaattttgacattaccaataatgattcaacaacgaagctggtattgaagtattggtaatgctccaaatgctggttagaaggcagtcaagtcaattgctaatgttgggaatggtgctggctggtccaccaattgaatatgatcgtggaataattgtagaatatggctctgttttggtgcatcttcctggaaggttgtatcattcatatttcaatgtttttgcgtaaaatattaagtccaaatcattatttactttattggatttaacagtgtttttgcgtaaaatatttagtcaaagttttttttttctaatgaacttgaaaattaagattaaaaaatataactatatttatttttcaatttttaaaatatagtaatttctaatttttcatcggacacgaaagaaaaagagagagagagagagaaagggacaggtaaaagtgcgtctaaaatgggtaaatgtttttctttaatataaaggataggtcgatatcaaaatcaataaattgagaatataaagcaatcgactcattctcttttactgttgcgcgtgttcttgatcatgcacaccttcgtgttccaatcgatcctttgaaatacagacaaattaggttaaagcgtcttagaaatctgtcttcataccgctgaatctggtgcttgtgattaaaatgaatgtggaaacttttttctcagggcatacgtgtatttaataaagcaatttggtaaggagtcaattttagcagaagggtctatcacattgcaaaactaaaattgtccaaaaatgtgatggcgatcgatttggaatcacctctcacttgttgattgaatgaatctgcacgctcttcttcaccttggagtcttctgagtttggatatttttttatttgtggaaatccaacacagaaatcaataatttataataatttacacactatttttaactaaccgtattggattttctcagtttagagtttgagaaatgaaaaaagataaggaattaaataataaatagagagtataaaatgaaagaaaaatatggtacaaacccaaccattaaaccttttcacttctatttgtatgtactaggtgaagagaaaaagagtttaatatatatgaagtgatagtataaaattgtcattaaattattgtttaaattattttaaaataattatattttaaagtcaataaaatattgaatcaaacaacaaaaatttaaaaacctccttcttcttccctttcctcctctttttttcccactccaatcaaagcactatctgagaccagaggaaataatgagagggatattgaatgtacatctttattggaacacataatcttcgttctgcgatttaaaattcacatcgtaagctattttttcatacaaatctaacattttgtcgactaaccattttaaaaattgatgataaaactgcaaataaaaaattcattaaaagaaaccccacttgtgattctaacaattgataatgttatctagttaacaaccatgcgtgaagattgaacttattatatcaagaatggctcgagttttaagtttttttttttaatttatttataaaaaaaacctcactcaaatatgacacaattctgcttagccactgtaaaattctttggtaagatttgttttgatcttaaggtacaagagaaatatttattttcttgaaaacttaaagttagaatgcttgtttttaatatttgtttttttaagtaacattacacaaagaataatatttccataaatgttttttaaatggtttctcacaaaattgttctcatgagagaggtgaaataccgactttatttttgttactataataataatatcacattattgaatcatttaaagtgataaataattaaagttttcggtcaatattatattattatttgattttcaagaaatttataaatattctcaataattttttatgttcaacaaaatagattttagtcattgctagaaataattatttttaggattcattatttccagtggaaaaaattttcctttcattaaacgtctcctttagataaaataactgcattttcaggaatgatattgtcaaaaatactataattagaaatgctatttttgaataagttcaaaaatacattttagtatatttaaaaatagtttttaaagttaaaaataatagtagaaataaaagttgtacttgaattaaaaataaatttctcatgttttcataaaaaatattataattctttacttttctacgtctcgttataagaaaaataaaataaaatatggtttattattttttaacatgaaaatatttaatgttttttaaaacatatatataataagcatgacattctcataaataaatttctaaactggaagcccacttcaacaatccatattattattttcgttgtatcttattattcaaacttgcgaattttgttacaggtgattaaaattatttacggtatggattttgactttacgactcactaatattcattatttttttgtactattatattttttaagtaaataggttgtagagggataattaaaaatatttttacatgatcatttaattacaaattacaaactgtcatatatttgcaaaattataaatcactcatatatatttattaaatttttgaaaattattctataacttatatttatttattaaaatatagatacttataatttattaacaaatatttgagtaaagatgtataaataaaattattaggttgtgtaaatttatttttaacggtatatatgcgaagtgttatattattaataataatataatgacttttgaatttaatatttaatattttaaatatatttattatgtatattattattattattattattatttatttccatacttattctgaaaaattaaaataatgatttaaactatgtatcttatagattgagttgaattaaatataaaggaaattaaaatgattatattagagttttatctttaaaattgatttgattcaacttgagatttatatttttttgataatttttagttttgagacttaataatacttaattttttattcttttaaaaagtattttgtgaaaattaaattaaattactcaaaatcaatgagtcacatcccattgaatacatgatgttttttttttcgatacatacatgaggttcatataaatagtagtaaccattatgaaattttattaaaataattcaattacaaaataaaagaaatcaaatgaaaattgaatgcgaagcaggtaaaaatcaggtaagaaacagggtaagcgagatttccgtacttccgttgcagagagagcgtggaaaaacacgcgacgaggcgagagtggaaaagataaataaattaaaaggcttatattttcctctcattttttctttttctgaaatttataattttaatttctcgctctccaaagtccaaacagaacacagcgtcagatcagactcagacaggagaagttgataagaacaaacaacaacgccaccagtttttttttttttttcttctcttcttcttccctactctcactccctatatcatttctccttccgtcgtttctcttctccctcgcgagcgtgcattgcattgctctctctctctctcacacacacacacacaacacgacgacgtcgccgccgcgcaccgtttcggttttcctttctcctccgtcgattgcttccgcaaatagcttttcgcatgggaaacgctaacggcagagaagatggatccattcccggcgccgccgatccctccgtcgccgaacccgccgtacgtggaactcacgcgccagactcgcgccctccggttcgcgccttctcatccgattcaatggccaatagcccgccgcagagccctcgccgttccagatcgccgatcctcttcggtcctcaggttctctccacaacatcctctttgtctcttgcttcctcttcgatttttctgcattttatttcgtcttcacgcttattcgtttctgctgaatttaattttactagctagggtggaattttggttttgttcggtcaactaggtcattcgttgattttactttctgcgttcggttggtgagtatcgtgctaacatttgtctggtgcatgagagacagagagcgagagattaggaggcagtgtaggtagggttactttttttgttgaaaccgtggattatttactgagtttattttttatcgccatcggagttgaaactaaatgtgttgttgaacggatctggtaattatgttgttgatggattcgtcctttcttgcatggatcatcatgaacgtggttcagattgaatgactgtgtttggatacatgttgtggatgtaaaaatttacgtcaaattgtagaataacgtggaagctataattcacagcttctttactgacgcagaaatatgcttccaaacacgcaataagcatgacagtgaccaacaggaatgtggctggttttgatcgaatgcatatggtttgaattttgaaaactcgtttggggagggcatggagggcagaatggtgtggatctcggagattactgctagtctgctacacctgcttgttctttttgaaaatgttattgatgtgtatttatatctgtctgttttaggagagttacccctcctttttgtagactctgtgcaatgctgcaatcgcatttttgtgcagtgacagtttgaaaacattttacttgatttatacttatgtgagtctcagcttcacagctcacacaactactacacacgactccatctaagtttaagccatcccacataattctttttccggttaaactcacatgttgtggatggttgtgaccggatagttacggcatttggaaatacacattcgtagttttagtctacaggtattaacctgttaattttgtctgattcggaaattgcatgcaataatgtcctctggattgagcgtgtgaatgtgctgtttggaacgtgaccagttatatcacttatatcatggaatcagttttatttgtttaacggtataattttgttttatgtcaatttttgtgatgcctgtcctccgttactcacattcctcgacatttctccatttgagaaacaacacgtgaaatattgcaatacggatagatgatactgcctgctaatagtgatgcaataattttttgtggttatgttctaatagctgttgagggtgtactttcaaaagtgctacacaagactacaagcttggcattcaatgtacattcaatatttttctgtgcctctattaccccctacccaatgttatatcgatcccatgaatttggtaaatatttgcccaatgtctcttttatgcctattaatgttctgaatgtcctttttttgtctttgatttgtggagaacctggtgaaaaagttatattctataggcacctctctctctcgtgtagagttgatatatttccatgtccagcaaaacttaaaagacaagacatgcttaagtttattttgtatgaattactgtccatagctatttggtggcacctttgcaccatagctacttgcccttgctaacaactccaatgaaactcttgctaacaactccaatgaaactttgattatattttcctataaatcaggaaaattagaggacattcatgttttagtaactcagttattgttactaataaacatagtagtcaatcttgtaatagtggttttgtggtatgccgcttcgcccctctatctgggattggtgactagactaataaatatgttagagctgttctcaaggttgtaaacgaagggctagtgacatacatgtgcattaataatcaaaacaacggctccactttgtttttttcctttttgtgaaaaaaaagtaacaaaaccttaaatttgcctgtctttgaatataaatttggaagagagaatattattatgtgccattaaataacatggttgctagataattttttttatattaatatttaatatagtttgatctgagaatgcattgtgtgaaaaatcatgatatacttgttgatggatcaacttaagttgcgtgattatacttatactttctattgtaaattttctttaccttgattgatttttgctaatgaattgaagaggttgacacttgacagaaatgtattgttttgttaattaaaatttctctatctgaaaagtgtagtttttttgttataacttgagcactctgttcttgttgacttagctttctcccatggaaatggtaaatatatttttatacatcttttatgatctgcaatacatatgaagctttctttcttcatgtgtgtgtgtgtgtggctcactgaaatttcaatttctttctagttaggatttttttttttctgggttaggaaacatgtaaatctcaccagtggcaattttgcattacttcaaaataaatgtagaatttccttgtgtttttcaggttcctctagctccattacaaagaggtaatggccctccttttctcaatcaaatgtggcagaatgagtctcacggtattgttaatcaacttcctgagcaagggatccctgtcatgattacatggaactatggtggtaacaatgtggctgtggagggatcttgggataactggacatctaggtgagatttaacgactccttttttggtaacaatagtgctggattgtatttgacataaaaagttatcataactgcaaatgatctacaatgagattagtaccagtaaattttattacttgcaggaaggcattacagcgaggtggcaaggatcactcaatccttatagtccttccaccgggtatatatcattacaggttcattgttgatggtgaagagagatttattccagagcttcctaatgtagctgatgagatggggcatgtctgcaatcttcttgatgttaatgtatgcatcgacctatttgtttctttctctttatgaaaacaacatcattttgtgaacatattttcatcatgaaatttgttctcctgtatatttaattgtgtgtctgcattgaaatctttttcttctgtgtcaaggtgaatgcttcagttgggttttaagatgaacttggcatacaacagatgccgaagatctttcccccctccccctcttctaggtctttgttgtatgttgtatttgtggtgaggagggtgaggacaggtaggggtgtgcaaaaaaaccggttcggatcgaactggattgcaaccaaactgaaactgaatcggtttttatccaaactggtttgaacaaaaaataaatgcacggttttacaaaaccagtttggttaaccgaattgtttatacaaaacctgtccggttaaccgaactagttttcaccggaatcaaattccttgtatttgaaaaacccagtttgaaattcgtttggttcttagaaccagtttaaaactggttcaaaaccgtttttaaaagccactccagttctgagccggttttctaaaccagttcggctatttggatataaaaccgatttaattgattcagaatcagttcggttcgatttttttaccgatccggttttttgcacacccctactggacaggtagccaggtgggtgggacaaggaaagggtaatgcatcctatgttgttttgttatgtctgcactctgcatgccatatgtggagatataggatgaacatagacgggaacactggtttctgcactctactattggttcatggaaagccaattttcataggtttttgtgcttttagggctgggcattagtgggactgttgaatgaaaatcgagtaataaaaactagcaaattgtttcacaattttgctttacttgactatcaatacaaaaagaaaaattcagttgatttgtctttcatttaatgatttaaatgttatggttttctgcaggattatgtgccagaaaaccctgatggtgtgtccgagtttgaagcaccaccctcccccgaatccagctatggccaagcatttccagctgaggaagactttgcaaaagagccgatggccgttccttcgcagctgcatcttactgtcctaggtatggagaactctgacataggttcctcttcaaagcctcaacatgttgtgctaaatcatgtcttcatagagaaaaatttggccttaaagtctgttgttgccctgggactcactcacaggttccagtccaaatatgtgacagttgtcctttacaaaccactcaagaggtgaaatatgtgaggcttgtcaattatataaactttttttttcttttttctttttggtagcctcagtctgtaaagatgaaaatttaaataatactccttgacaggtggtatatgaagggcttgtgtctatatatgcttgaggcttctgttcaaattgataaattaaaccttttgtttcttttccttcttgaattattgaagtatcaatagggtgcagtgtcttatggtaaagctactggaggtggtaaggggttgctggtcataattatgttttttggatcaaaatatcaaattattagcttaaaataatggtacctttggatggaaagacaggaaatatagagaaagtaaatagagagaaaaataacatggatattaatatattttctctcgatggaagaaaaagtgagaaagagaaggaaaaaattgaattttagaaacaaatttggcttgcttattttatatttttgaaaactgttttctattctttgaaattatttgataaaatatattttcaaaacaatttttttttttagtttttaaagccaaaaacttgtctcattttcaaatcttgttttcttctgtgtttttttcttcttttctgacatttattctttaaaaatgagttttgatttttttaaaaaaaataatcaggcacatcttttttttttttttcattgcactctactggtaccgggataaaaatatagatgagtaaaatgtcaagattttaatattgtcgggggtaaatttttcattaagaaaaattagccgctcggttcttatattggacaaacattagtttctacacttatttttttaattcatacacgataacttttgatccctgtttttccttttcatcatttgtgttgggttagcaaataataaacttgaaattataaaattgtgtctcactttttacttaaataaatgctaaaatgagtagtgactttctatcatattgtgttattggttaaagtttatcaaaaattataaaattttgtatttcactttttatttaaaagagactcacttataattttgtagtaatagattttaactaataaaataatagtgtgtactcttctaaaaaaaaatagttggtaacggaatacattattcttgtacactttttttggttccatagaaaagaaggaaagagaggagacaaaatgaagaaatagagagaagattgtcatcttttcttggtagctatgaaattgaaggagaaaaataaaaaggtgtgggatttacattttttccccacaaaattattcagaaatgatcaatagtactcatttcttgcagaaaatgattgattattttttgttgttagtcgattatcattagcgtatatagtaaaaatagtcaattttcaaaaataaaattgattttcatttctctcgagttgctaaaatctactttcatacataactggttttggatattctaaaatagtaattgattatgcattggacccatgaacttcaatcgattttcatgcagtggacaaactgaaaatccattttcctttctagcaaattgattgcaagagtttgataaaaaaaattaatttaattaattattttttactctttttcttatttttttatttctcttaaatcaaatacctctaaattcattctatttatctcatcttttttatctattctatttctcacctatttttttcttcctatcaaacacactcgtaatcattacatgcaaatagtagaagtagtgagtacaagttcaataatcaaaggaagacatcaattttcattttcatttaaaggaggacacatgaataaatgcgatatcttctatcgatctatctctagagtaacattatatatatacaataatttatatcaagagcagaattgtgtgttgtctgagggatcccgcagagttgtgaagatattttggattttattagagagaaaaattctaattaaaatgattatatataaaaaaaaagttaagggatcaacaacacctcctagactggaaaaaggtcgatacatttttgttgaatgaattcatttttcttcttctaattatgagaaatatggacccaaaatattattgtcctttaatttaatgtatacatgttgttaaatttatattatttgaataatctgcactgcaccccaagagatattgatatggttcctcccttacgtgaaacaaaatcattgagattcttctatccaccttattattttctccctcttcccttgcatttttatcatttctttttcttggtgatttatctccttttaacttggttcctttagtttgcacactttattctgcctacttgcttttctttccttttcttttttaaaaatccatgattgaagctttgttctattcgagatttgaagtatgtagctattgcatgcatgcctaaagagaccttagtcggcatgatattttacatacaccaaacaaagccaacaaacatgcttgtccccgctccatgtttaccatgctaatgctaatgatatatttaatttaaaggaataaaatgggtataaaagtgaaaaaagatgaaagatttaaattaaattaaagaaatgaaatgagtgtaaaagtgaaaaaaagatgaaacaagataaattttttaaattaaagtaaactaatgaaatattagtagaccaacaccaattcttaaaattttgatacccaacataccaagaggaaaggaaccaaacactaaccatcgtgagtgacatgccaaatcccaaaggttgcagaaatgaagatgccacagtatggtaagcaggttaggccgtaccataaggtacagcatgttactatttataacatgacgactgtgccaatacagtagtacaaatgtacaataccatgtactgaagattccttttctttttaaggatgctatcacttatccaagttaacagaatcacgacaaattggacatctggaacatgaaacaaggatctggatcttctagacttctacagttgcaaatcaattcattaaagttaataaaatttaattttaaatgttaatttagtgcataataaaataaaatgaatggattcataagattcagccagtttctctaaaaactgttgaggatcaaaatctcgaaagcatatgttaacagagtcatttccgtgggataaattattcaaaggtcctctcatgagggtgtgtttgatacagatgcaaaagttatttcaataatcaattacatgtataattgattataattagaattgatttttatttgtataagtttgttgataaaaatcagctttcacataataaattagaaaaaaaagtacaagggtattgggcaaaagttgttgggaaatttgggaataacttaagaattatgtttttaagagaaaaaaggttgttgagaaataatcacagattcaaatttttagatatatgaaaacatcttaattatttttcaatgtattttcttaacaaatatttagataacgaaaacaacttattttttcaatgaaaaaactttttatcaaattttagctgatgtcctaaacactaattatttttcaaacacttttatttctataacaaaagctaaaatgaaaaaatagggttaaatctatttttggtcctttaaaaatataacaaatttgattttactcctttaattttttttcctttgcatttgattccagaattttagaaatgttagattttagtccttttgtttaactatgttaagaggtaggagacagtgtggtgagtggattcaattaggatcttgatcttaaccaattacatccactcagaatagatccctgacgacatccgtcaaaggaacattacttctccaatcatatatttttattacttttttactttttgtaattatgtttttaattggttaacttaattttgtttttaatttttctaattagttacatgccatatcaaattacttcaaaaccaccgactgggatgaccacgtggtcacatttaactatagaagaagcaaacataattttaaaaaaactaaaatttgatatttctaaaattctggagattaaatgtatttttttcttttaaggaattaaattcaaatccaatgtattttcaaaggacgaaaatatatttaaccccaataaatattatccaaaacatgagtggaggaaccctccaaacatttaaatcattgatttaagtaatatagaaaaatggatttttttttttacaaccaaatatattgtcaaggaaaaagtgaaaagagtaatgcctcattcatcagccaaatacatttttttttaaatttatctctttttatcacatcacatcttccataaggtctatcataggtgtttatacccaaggaaaaagaggaagaagttggtgcctccacgatggtggttctggcattgtgcatcttcaaaagcacccacatgttaagaattggcgcagtgattttgactttgcttgtgctttcgcagtggatttggatttggatttgtattttctgctgctagcacaatgcctcattctgaaagaaattaatctcgtgccatcagtaagggaaaatctttcgtgctcaggttggattgtgcggcatcaatgtcccacgtagaaccatttaatgtaacaataaataatataatgtttcattatcttaacataattgctaagtaaacatttttggggttagcttcgattttcttgatcctatgcctttttatttgggttccaaaggcacgttcacgggacgtgtattagtttgatgtttgcattttaagtacattattatcctagttatcggaaacgagatctaaacaagttggcaaggctgtgcatatttctttaattattagtaaaatcactttttattttgctaaaggcgtgttgacaaattaaacacaacactcctgatctagatcgttgccatgttgttattaacttcttcattattggattgaagtcgagaaatgcaaaatgatcacagaaacaatcatataatagcataaagacggttttaacagtataagtcacccacatgtaaaagcaccaattgcaaccaattgttccagtttcatggtagtaacccaaaaaagatgaaaagtgaagtacaaatgcatggtgagacacagctaatccaagctactaaaacaagggacagagcaaacaagtagaaaatactaatgagcaataccaataaataaaagcaaacacaaacccgaccaacaaaaactaatgaccccaaatgaagattgtcctaatgaaaatagatttttcatcaaaacttatctgccctgtcccttttctgttcatgtgctttcaaatgttattgttatggttgattggtcctcacttggccatcatgactttgacaaactcctcgtagttgatctgcccgtcaccgtcaacgtcagcctcacgaatcatctcgtcgacttcctcgtcggtcagcttctcaccgagattggtcatcacgtggcggagctctgctgcagagatgaaaccattctgatccttgtcaaacacgcggaaagcctccttcagctcctcctctgaatctgtgtctttcatcttgcgtgccatgagattgaggaattctgggaaatcaatggtaccattcccatcagcatcaacctcatttatcatatcctgcagctcagcctcagttgggttctgcccaagtgaccgcatcacagtcccaagttccttggtggtaatacaacctgtatcatttggaaacaaaagaaaaaaagttaaacacgaacaagaaattcagcctcacaaggaaatgcatgatccaatttaagaatcaatcaagtgcatgtttggaaactcatcacaaagcaaaatattatgtcaatttagttagcttcaggttggaaaaacacattaacaacatgcaaccaaacacgttataagacgaacacttagatctaaaattttggttttctgctcaaatcatattcccaagtttcgttcaagagcttcaaacacatcaacactaatgacgggaatgtgaacatggggagtggtatccataatattccaggttaatatgatcttttgtctacaatttcataaatctataaatgtattataacgatacaagactcacaaatccagtactatgggggaaaaaaatcctttccattcattataaaccacgcacaactcaacaataatcaatcataaatcccactttcttattctgataagagattcacataccatgcaattcttatttcattctcagatatatcttcaaaagtaataaatggaaaaaaaatgcagtcaataaacataaagggggtcaatcctatacgagtaattatataaacatacattttcatatttccaacccattttcttcctatctctttatttcccatcatatcattatcaccatctcttcctacctcaatccacctaaaagggggggtggaaatttatatttttccattctatattaagttatttacaaatccaaacatgtagcaccaaatgtcacatccacacaaacaattccgaatttctgatcgagaaatcaaacacccacaaatcaaatctggattcacagttgaaaacattcaccccaaccaaccccacaatcctagaacaggaaaaattatcacatcacaagcaacattagcgaagggcaaaacgggaaaaaaggttggatatttcagcgagaatgcaaatccaattcattcataatacacccacaaacatcaaggagcaaaaagtgaaaggagaagacacccaatgaggaaaagattaaaaattcaacaaaataatcaaaagggtaagaaagaaaacgagattggaatgagatctaatgataagagggagagagagagagagagagaagggatctgagaaaagagaccatcgccgtccttgtcgaagaggctaaaggcttccttgaactcagagatctgttcgtcggtgagttgatcggccattggaaattaattgatcgatggatctctctctttgcgatgtgatgtgatgtggaaaaatataggaggactatgttatttatatgctcttacaaacaccaacgaggacttctcttttctttttatggtgtacttaattccttaattcaaatataatctagctgtcataacgccaaattaatgtattattctctaacaatagaaccaacaacactagtagtaaggtctacacaaaattacaatggtacttaactctctaataatatgtgcttttgattctttgtttgatgttttttaaaggaaataaaaaaagtaaatactagtttatacacttttatatggttggttaatcatgtaagaatgtaagataatttgttaattttataataattatttttaaaaaaataatatctattgaaatattttattggtgaactgcgtaatttttttatgctgataatgcataaaaaataaaatctaaaatgaaacaaaattgaagagaaagaaagaaagaaagagagcagagaaatggagaaactcgcaaattcattctcagtgttagaactcgacgccgacgatagccatgttcccaccactgccggtacccttttctctcttctctctcccattcaatttccacctttccatgcgtagttgatgaactttgggttagggtttcacacctgttcattttgttgctgatgaatttttaattttattttttttattgaattttgcgttgaagtgtgtttaatatcttgcaagttggtcgttcagtgcactgctccaatgctagagtgtatcacagagacagagtgacaaaacatcaaatttttaaatataaacgaaaataacgatgattcaattctaatttatagtgtcttcactttgttgaatatgagtgcttctgctgcaacaacatgaaaacacattgcaaattttaagcataaaaaataaaaaacacaacctttatctatttttctatccctcccattctttctttctactattatggttatttttctctgctgtaatctaatcttcatagctctagtgcagccactgaattactacttctatttttattttcttttgtgttcaatttttcttcttttgtgttttgattcttgtgtttgagaaactcaaaaaataagcttatacccgaattaacaaaaaataagcttatgaatcacctcatgctgatatcttctgtagtcaacttgttgttctccatatttatttgtactaactagttacataaatatcctggatggatgtttgctacggggaacattatgttgattactatgaagtgaactagcagctaaaagatactttcatggcgcaggtagtagtgacaagagggttaatgccgacattgacattgtaccggtaaaaagcaagaaacaaaatcaagaaaatccagtgactccttcatgtgaatacaagttacctcttgtgtggattgacttggaaatgactggtaagcttgtagaatgggttgtttggagtgtgttttgcttgtttctatttagataaatatttttcattatgtttttctttgtgtttggtttgtcttgttctcgaatctctaaatctttcagcaacaaagctcttacattttttgatattgtaccaatacttgtgttaacatggctctacatctaaggtagaattatagtaactcaagtgagccttcttcctagcaatttggataaactttatgttttggaaacatgtgctctccaaggtgaattattgtttagtattctatccttccgaggattattttcttaaaaaaaaccgtgttataattagcagtccctctctctatttcatgcttttaaatgctttcttgaaacctttgctattgttgggcttatcaactttagttcttgacctgctaaaggcatgtctttttttgcttgaaggactgtcagcctatgatctgaatgttatttggagttcatcatctgcatgcaccctcctgattttgcttataaaatttcactgctagttatcatttctccattttgtaaattttatccggtagaatgcatttctaatcctgcctctttaattgcacaacttctgtgttatgcaattttctccttgttgacataattagaaatcttacattagattatctattgttgttgtatttactattttgtggtgctcaccaagtaggctatatattctttagtcgcaaactatgttactgtcagttcttggataacatttgaattgtttagtgcctgatgatgatgaatgttgaaccttctctgtatgtgcaggtttaaatattaaagtggacagaatattggagattgcttgtataattacagatggaaatttagccaaaacagtggaggtatttaattcaatgttataatttccatgctcattttttgttttcgacttggtcgtttccatgcttcactatattttaaatgagattctacattctcccgtctctagctaataacattcctctttcttacttttttcccctctctgttttttatatggaaaaaacttgcttattccatagactagaacccgtcttactcgacattttgatgcttgtaagcgggaaattatttagagttttttcctatctgcatatcatactaagcacatggttgaattttatttgaaatcaaaaaatttgatgggtgcttcaccttatttaatgaatctcccctagttttgcagttttcaataaattgtaatctatatgagagtgtgtacctagcactccgcttaaaagtaaataggtaatctagtacgtacgatcacgtaagagtgtgtatgaaagaaagtatctgctatttttagggtcctgatttggtcatccatcaaactaaggagtgccttgacgggatgggagaatggtgtcaaagtcatcatgcagctagtggtaagtggtaaatgttgtattttgatactttgatttttgttaagagaaaaaaacattttattagagagatggccatggggagtgtaagatatccttcaaaatagataaactaatttaataaattatagaatatgaagaaatttgagactatattattcacgagttgctgattggttgtttttccttaacattatttagttcacttttatttccttttgaattggattttaaatggcattgactaacaatttttcaataaatttagggttaacaatgaaggtgctaaaaagtacaataagtgaaggagaagctgaaaagcaggtttgtagtaaatataccatgtggcatgtggcaagctctcttttcataggagcttactttctatcaactatcatgttaaatgggtactgtattttctatattcaatgaacttgaaaaaatgttatcctttttatagacatatgaaatagttaaacttgtctattagggattgcagaatcttagtatatggaaggaaattgaatttctcattatccatcacaaatttcataaaaagtatttgtgtggcacattatatgtcaggaaagtttttggcagctgagaaaaaaaatttccctaccagaaaacctgttcttttttctctaaagattcatgttactggcatgaacagttgaaataaatgcattttaaattttacttaaagagtgatctggtcattgtgtaacttatataatatatttaagtagttataacttataaggctatacagttatcagcagatcgctgctgtttcccttcttctaggctggtgtttaatgtagcacaaatggtttcttatgttgtgatatcaatgtagtgacgtgtctagtcttttagaaccacaccccaaactagttattgtagttgaaggacctaaggccttatgaaacccatacttccaatcatacttattaatagcggcgctattgcgcgctttctaggagtagcggtgcagtgcgacgaccggccgccacagaccgcattgtgacagtgagactgagggtagcgctagtagcggccgttatcgcgactgagttgcggctgaaaagcgccgccacaggaatctgagaaaacgaaatgcatcgaggaagacgaaagaataaggaagaagaaaggttgagggtaaaactgtaaaatgactattttattcctgaaatctcttttattttaacatttaagagaggtagaagtttaagtaacagtaacttttaagaggtaaaaccgtaaaaaatttaaatctctatgattttaaaagagataaaacagtaaaagtaaaagtttaccttattttaagcaaaaaaatccaaacgtctatttaagtaatgagaatactactaggagaatccaaacgtcttatataaatccttatcacccaatattttcaaaattcatcctcaatcctaatcgtcccatactttcaaaaactctcatctcctcctcttccaaagcattcaactttgttgagcaacactggttagttttatattatatttttattttatcagcaattttttttcttttttttttgtattaacactggtttattttctcaacgttcattttttttattatatttctattttttatcaacactattttattttctcaacgttaatttttgtttttgtacctctgttttatacttttatgtttgatatttatgtcatattttttttggaggattatgtttgtgaagtttatatatataattcatttcagaatatattcacttatatacttcgctgtagcggtctactgctacgcgctatagcattttttaggggtggttgctatgcgccgctatctgagattaataagtatgcttccaatgcaggactcaagtcccataccttgcaattggatcctaacacaccaaaaaccaataagttggtagtaaacaaaactagtttgcatttggcatcctagtcctgcatcaagccaatgatatcagttccagtcatatgggagtagtgcttgggtgacacccatgtcatatttgcttgttgtgttggaagtgtccataaactgatatcctttttcctgtatattgccacttgatctgtgatgaactgaactattgacgtactacttttggtctttactggaatgcaatgaccgagtctctttccctttctttgttctattcatttattctcttttataatgaaaatctgtaatgtcttgcaaaattgcaggttattgaatttgttaagagatatgttaatgttggttcgtacacacctctcttggcaggaaattcaatatatgttgattttcaatttctgaaggtattggttctgccatagtaacttgtagaaagtggctctgctgaagcatcattaatttataaattctaattatcataatgttgtttgtctttatagaacagatgtattcctcaagtctcggattcttttgttaatttctgctgaaaattattggtcacatcgcataatcaatttttttttataaataacatcatatttcaatacaacaatattgggtattgtttatatttcatgcttgccaagtgatggtaattttgttggtcaacacatcataacatttatgaagttggacatctggtaaaagatcaggttgagacttgagacactgatgaaaatttatgtcatctgaatatagaatctctatttttttagaccagttccccttccattctgcatatcctgatcaagccttgttaaaacatatactgctatttttatttggtaccgctatatttcctattgttcctgtttgaaatgttctggttctgtcttaactagatcaatttttgcagaaatacatgccaaaattggcaagtctcttctctcatgtacttgttgatgttagtagtgttaaagctctctgcattcgctggtatcccaaaggtgagaaattatacaattagtatataattaaattttctttggtattagtgcattaaatcatactgaagtttaatatttgttatgaactatcaatcacttcttgatcccttaaggccttaatctctgccccataaccatcttcacccccataaaaagaaggaattgttttgtgcttgagattggtggtcagttccagtgcctatcactgcattgtttttactggatctgttatgtaaacatgattcttctagtttttttggtgctattcatgcaatataggttagctccatttggttgaactggtaagtaatatgataaaacatctcatttctatcagaaagttttcaatttccagtggttatgatttatgaattaataatttaatatggccctttttaaaccaaaatataaagaattccttctgtcagctgtccttttgtgtcaaaattctgattgacttcctagttttgtttccctacattttctgcaagccatattagtagggcaactttaacacatggatcagaggttttaacatgactaccccttcttttgtatttctgaccttggctcaacatcccaagggcaaaatacagttgagaaggtgaaaattggaaagttaccaaaaaagtgatgttttaaaacttacacaagattatggacatgctacccgtctcctcaaaaacaattcaacttatgaacaaatatacattctatgctgctgttatttagaggtaaaatccctcagtttttaagggcctatgactttagatatctatgtaatagcgtaaagatgcttagaaacttggcaaggtaactaaaggagatgcttgttgatatattttttgttagttcttttgatgttttaactttgaagcttggaatctcaccactaccccttttgctcttggacgtcttgatcataattaatgactatattttacttacaaatattctttgcccccaattgtaataatacacggtaaccatttacacattccaaagagacgagaaacaatggatatataagtacttctgggattttgatccttgtttttacttgatttttttttaattataatcattatgttatttcctgttttccaaggggagctgttgactaattattaattaatccatctgagaaagaacttcagatatgcctgcttgtaaactataaaggcttatcatttgtgcagatcagaagagagcaccttcaaaattaaacagacacagagctttggatgacattagagaaagcattgaagaacttagatactacaaggcaaatatttttaagcccaagtccagaaagtcatagggatgcagagaaatcagcgtaagaatgatgggcaggttttcaggtcaagtgtaaaatcttattgttatggagggtttgcgctgagtaaatggctcgtcattttggataaagtgtagttactgcaaaatcatatttaaatttgtactgaaaaccatgatgtgcaagttaaatcgagcttcaactccattgtccattaaagaaagaaaaaggaaatgtaaatgttgattacactacccaaagaaatgtcatgtactaatgttttgtttggtttcatgttgaataattaattcttagtctagaattgattttagattaattttcatatgtttgattttacattaaagaagatttcaaagttgattttggatttataattaattttaagttgaaataattttgagtaattttgtgttatatcaaaaaatttatattaaattttatttttaacttgattttataataaaaatatttaaatataagttatattattttaaaattaattttgaataaaattaattttattcaaaattaattttgtcaatgctaaaaacaaggagcaattgtacattatatatgtaaataacatgggtaaaagacgtttggacagagtagtagcatgagtaacaatcacaccaaataagcatgtatactaactttaaggtaacaaacgaggacatgaattatagtgttggaaatcacaatggttattttcatttgccagtttatattagaaccaaagtgcgggaaagaaaaacaaacaaagagtatagaaaactctacaaatataatcctttcataacctcctatagtattacactttgaatgttatgagcctgtgaccagtaactttttttctttctgaagtcctagagtgtcaaccattaaaaaccagtccatccaacacagatgagtagataactttatcaggggaataaaggtcatccacaaagaaattaattccatcagtcaataacacgcctgcactgctttgcagctgatgtaaacattgtttacaatactattacctgtcattttctacttcctatctttatattggacttcacaaatgcctgctgagattctgtaaaagtaatttcagattcctttttgtagtctcgtccccagtaaaaccaacaatatccttgctaatattctgcagtgatacagccaaaaatcaaataattagatggggaaatgaaatactattcataataattagatttagttattttgccacattagggtcatacctcaatgttcttcaaggtaaaactaattgtgtttatggacttctgaaacagttcagtgttctcaggggtcatgatggatgaatgtacccttctgcgtacacaaagggtgatttctgttagtcattatacttaagaatgttctgagtgtaaaattaaagagtacaaggaattttggaatcagtccaattctgtctagtcctaatgggcaaaagcacacattctggataaacataataggtgaatgcttttcttatttactagagactagagagaataataagaggactttatgatcaatttcaatttatagggtgtgcaactgaaacacaagaaacaagttacgacatcatttttttgccgttatcccatcaagtctccctcaatcagaatataaaatgttactatgttagttggcatcccctacactaatgggtaatgtcaatgtgctacatggcaatctgaatataatgatgcatgcaagccaaattggtgatagacaagagccatagaagtttaggcaattaacctcaaatcatcagaagcttggataaggttttgggttaaattctcaacttccttcaacaggccataatcacggacttcagccaaccaaggttgaacatcttcagccatggctttgatctgagccatcaatgcatgacagaatgattgacaataaaaaagaaacaaacaaatacctactgcatagagatgataaacgaatgtcataagggtactatacatgcatattcaccattattattttatgtttttggagatagaagaaactaatatttcatttatcatcatgaacttatctatttttctgttggcaagaaaattgtttgatccaaaggttcattcaagagcactacacctgtgtaagaagtggtttcgcttcttcaataatggaaaatactcgttgagccattgtatagctattgatgataccaattttctctatctcgagaccaagccggatgtaaattccaatcaatgtatccaaacttgttccttggtcaccattgatcttttcgcgatcacacacaataagaccttccttagtacagtcttggtgaagagggccaacagaaggtgttggaattggctcacgaggagtgatgtcaatttttgtttccataagaagaccggactggttaaccatgatcaatgaatttcgcggtataactgttttatcgtcaccaacctgcaaatggaaaactggtggtttaataaaacaattcaacaactaaggtcctacttagataaacttctccataagcacttactcgagaagaaaataaaaggtaaacagagtcgagttttttccatcagctaaaatcaacttatgcacttcagcttttattcagcattcacagcagaaacataatcttattttcttctcctcttataaatgtttatggagaaatttatacacaagcgacgttaaacagacaatgtcaaacacaagcaagattttaatccagggatactaaagtgctcaattaaagaattgaaaggcacctcaacaactacttcaatacttttcaaggagggattcacaccaatgacattgccaacagtggcccctctgattctcacaggcgttcctttgcttatgccacaagcttcagcaaactcaaacaccactgtgtacttccggaatttggatctgatttggaagcccctcaaccaggccaagctaagaacaaataggacagtaccagacactagaaacagtccaaccccaccttcccagatgctcctatcattgaaccctaaatcacttaatggccgcaatgttttcctccaaacggcccatggaatgtttgacaaagctgaaagtggtttctttgcttctgaagaagatgatgatgacctttggccatgacctgaatcagcagatgtagctcttttcctgttgatttgtgtctggcgtcgaattggaagagggatgaaacttgaaggatttcttggcagggtaatcagagatgaagaaaaagaagttggcaatgatgagacatggagtgcagggttcccaaccatcttctcaacaacctcttagccctgaagttctatcatccacacacacacaaaaacaaacaaggttttaagctacatcaacaaaccaattgaactagaatcaaaatcatataaatctaatcagcaactaataatacacaattaaatgacaacaattaaaaagaacaaaaaatacaaacacagaaggcacaaattacatatataaattccattgattctaataacatcagaaaaatcaaattggttggaaatggacaatgcaggggatatatagttatatttcaagcgtaggataataaaacaaaaacaaaaacaaaaaaaaacagacttcaccattccataatgtgaatattattgcagaaatggaaagttagcaatttgagggtagcataatattgggtttggcttggttggaccctaaaccgaaacctaacaaaaacaaaataccgggcaacacgtaaaagcgcttccaatatgatattcagcaccaaaagataccattttttacctaacaagcaagtaaagtagattgaaggatgaagaaaatatttcagataaattgaatgccaaataaaagtctcttgatggtggaaaaaaatgactaatgttgggtccttgaaaacaagtttgagtgacagtgtgacactgttggcatcatcatcaaacaaataaaagagacattatcgtagtgtgaatggaagagacagaaacctatgcagcatgaagtagcatggacatcaataagagtgaggcatttcaattttaacgttctaagaaattgttatatacaacaatttggttaaacaagtaaacgtatcatgaccaatttgttttttattttatttatttttataaagacaatttgtttttcttttctagaatcatgaacaaattgttattaataaataataacactctttattgcatttatttatacaaaatttcatgttaatcttttttattaaataaatttttaaaaaaattagtggaaaatattaatttataataaagtgtttaaaaaagataccaaccaagtaatgtattataattattttattaggaaaactacgtaccttattttgtcaaataatcgcttatgtatgtcatgtaatttatcttatacattgtcatttaataataaaatatattgttgaaaagtttgttggttgataatatgatgctttaaaaatcacacaaatgatgaattttttttgttggtttggccctccattaacattcatggctgtgtctgtgagtgcttcatgatggtgatgcccaccaaaaaaggttcatataagaatttgactgcaataccgttcaaacgtcttcccatttttgaaaatagaaagaaatattgcagaattgtatataatttaaaaaataaatgcacagttaaaagaaaagagaaaaagggaaaagagattctcactgagaatccaattaatccaaatcaaagaaaatgctcctaaagtgtcatcacgatttttgccgcttgaccaggacaagttagacaattaggtatgtttgagtattatcattcactcaaaaagagaaatttttgggtgtaagtaagatatttttgttattttgattcattcattattcatcatgtcagtttgtagatcattattgtttcataaattaatgataatttttaatttttttaggtagattgctgacatgacaaacaataaatggatcagaacaataaaatgtcttcctcttcctctatgtgcacctaaaaatttctccactcaaaatcaaaattttacagtggttggcgttggttttcaatgttaatttttattgcctgacttactgaaataaaactttaagaatgacattaaaattttaaaataaagaaaaaaaaagttatgaactgaccgtgtaatttttttccatatttatccaatcacaattatgataagtaattcaaatagtaaattatgattgaataaaaatataaaaatattttatattattaatatatatgcattaaactctttaaaaatgtaataattaaattttgttcaaatttaaattattggtatgttgtgtgatttaaaatatcattaaatattaattttcatgttatttataatttattaaaatttggttgatatattatatatttgattgttttaattagatatatttaactacgttaatagtgtttgattgataattaatttaattttttaaataaatttgaattcaaaatttaataaaagatatactatcattttttagattaactaaataaacaattttttttatcattctacttatgattttttctccttttttatttttcaacaaaatttgacagaattatataaaaaattaagaaaattaccatgagtatatatttagtttaattaaatcttaaatcttatattaatttttattttatataatactttaaataatttattcattctctggaataatttttataattataataatcaattatcatgtgataaaaataataaataaatttttttatttgttaattgtgatatatttaaaacgttaaaactgtataattaactacaagttaaaaatataagaacatacatgcaaaacataataaatatatttaaccaagaagacaaaaacaaattacaaatctaactatcactgcatcactttacaagtatatggttaggatgcagaagtgacctgatcctatgttttttttttcaaggcttaataatacccaaaataaaatcagtcaggtataaactttaaacatttttacaaaatatagaattaactatgactaaccactgaccaaataagcacataaaagcgaatggattgggtgtcatgttaacaaatgtataaagtttgacagcttgactagttattttgttttattttatttaattgaaaaataaaagatttcacatattttatactatatataagaaaaaattaattaaaataaaaaacattttcttatgaaacatcatttccttgaaaagtatttttttaataaaggatataaaataaatagtatataaaatatttttaaagtaaaagttatatggaaattttttttggacaccaaagtcttacagaaatttaaaaaattataatttgctcttttcgtcgttttactaaacaatgaaatgtatataaaaaatatttaaacggaacgacacttttattctaattcattccgctctattatatttcgatctacttccttctattctttagcatcaattcagacatgggcaattataatttgtagaataataacattttcttttaacctctttctctcaatcgtctattttcattttccgattaatcagctaaccatatggctacatatcagaaagtaacaacaaattgaaaagatattactagggagaaaaggaagatagatatatatacaacttttcttacaattttttgtttcatgaacataactggaattgttgatgaataaaattctaacatgaactctgcatgctttcaaaaaataatagcatggaacctaattaaatatccaaacaaacctacacgaaggaacctaattaagaggaaataacgaatgaagcaattggaaaatagtagaacctcagacataaagaaaattacacttgataatgataataacaatatcactttgtttctcgcatttgcatatcatcttctgttttccagacaacatcatccaggcttgttgaaagtttcttgtagaactgcagagggtggaagcaaacaattgaaattacaatctgtctccaattattcaagaacaagaggatctaaatttagttattcaaacgacaaaacttaggtagtttcttatgtctttgtcatcaagttctcaagtcaaataaacgacaaaacttttcctaattcagccacatattctaatggaggctatcaatcattgggaaaaaaaatctacgtgtcattgtttaatttaagaacttgatgatgattgatgaggatataagaaacttgattcaagttttttttttttattcaaatatgtaattatgagatgagtcatgatacaatggtaaaattgtgtcttaacgattattgatcatgagttcgaatctgaaaacaatttctttatatatgcaagaataagactgcgtacattatccctcccctttaccttcgcataacaaagagcttccggacaataaggtacataattttttattcaaatatgtaattgtgtaccaacacaaataggaagtataaactaggcagaaacaaattattggtataattattaattataaaaaaagttgatattgacaaaatgaaaaacattgatgctcttattcccatccaactgctgatataataagcttctttaattatttttaaaattgaaaatagaagagttatctttgaagtggcaagcagtaacacaattaagcaaagaaggggacagaaggataccttatggaactctaatgtatctccttttgccttccgtacctcaaccatgtgaagagaaggtgccacttggaatatctgtttatgattgggtacttttgaatttcagtacaataatgtgataaatagtgtcccacatcaccaaataacaaaacaaaaaaatcatacaggtttagttaatcatttggtccctatacttaccccaacttttcgctactttttagtccttatatgagcaattttgttttatgttttagtttgtgttagttttttggcagtgtaaaaccactaaaaatagagacataaggactaaaatttaaaagagattactcgtatagggaccaaaataatgagtttttatgtatagggactaaaatgaaaagttgacaaaggtacaggaaacagatgattaattaaaccaatcatatacctctgtggcaacattaaggtttcccttccttccagctttcacatttgcaagcctcatctgcaggaggtgatgatttattaattttacaaacaattatttaatagaaagtcccctctgagtagaagcttgtaatttgtcaaggggataggtttaccttgtaatttttcttctgcacatcaaagccaagaggttttgcagcttcctcaatcttgttgattatctcatccgcagtggattttgaggtgaatcttgtttcccttttaaatccctgtggtcagtgacataagaataaagcaagcatggtaactttagcaaggtctctcataatcatcaccaatttggcttgaaagaaagttctcatccaaattaagttcaagtttcaacaaaattaactattttttatctaacaaagaaactagtttatatgtaaaaatttaaatgttcatcacaataataaaaaactttagaaagcatcttatcatgtgaagctttgaacctgctctgtatcaaacaagttttcaagattaagccctttggacatggaaattaactcgaatgcattcatggctgtaggctgctcttctttcttctctgtcacatggtgctcctgaatacacaggcaaaatcatttatgagagaagattctaaactaacagaaaatcaataccaaaatcagatctaataatcttcaacatacttcagaatctttaaagacagcttcaacatcatcgaggttggtttccccgttctcctcaaaaactggaggcttataatctttcttaaaccattcatcatccaacatctcaggtatagtgatacgctgccatacaatcaggataaatcagaaatcaagaccaaaaaaattaactagagcagaaaaatgaccatgatactgtagattgattatcaatgatcaattatcttttctttatcacttttgttgtggtgcagagaactagataaatgtagctctagaagaaccattatactgatttgcataatcaagaaatcaaactgatgcagatgatatcaggccaaaaactttgtccttagtgatcattggaagccaccaaggaaatgcaggttataacttgttataagtaaaatgacccttttactttcagaaaaaaaaaattcaattttacatgacaagaagcaggcatataatcaaatgttgcttcttacagtggtgggatcgggatccaagatccgtgtaatcaatttcctggcactgaaagaaagccatggggggcaagtaaattcagcaactgagatctgtggatcaagaaatgaaaaataataaacagaaaacaaaggaaaaactaaatttttgaagaaaagagtaaacagtgctcacttttttatacaggttcataagattagggtcatcgaaaggcaagtaacctgcaatcaatacaaagagaataactccacatgaccacaagtctgcagttgccccatcatagcctctatcgttaaggacctgtatataacaagagtatatagttagaagtgtgactcaaaatgtatgtatttcggtatacaattcacatgaaagtagcataacatttgtctgtacctcaggagcaacataatttggagtgccacatgtagtatgaagaagtccatcatcctatcaagagaaaaataaacatcttaggatgcatggcaacttcgtcatgttgtcatcaatattataagaatatgttcaaaattataaccattgacatgttgggaagagagagagaccattgtcttagacaggatccagcttaattttcatcgagtaaagtaaaacaaattctaattttggcacatcaattacaataaaagggaacaatggtacttgataaccacttcttcttatcttcttaaactcaaaaattgcaagtctacacattccatgagaatgaaattgtggccttttctattaccaatgtgaattatttagttttccctttcacagacttgtacatagtttatgtaattctggagaggtatcaaagaattgatggcacaggataactgagtaataaaaggattttaatatttatgaatgatgaatgaatgattgaatacaattttctgacactgtcaactcttgttccatcttcaataatgtcacactcaaaacatggtatgctttctcttcctaaatcttaaacctactattggcataacctcctaactcatccatccctaaattattaagacaaatcaaatcatgtctctggtcaaaataaatcacctattactattcttatcttcctgtgtgattgatcttctttatgcagttcttagaactaaacatatattttaccatcagctgaataagataagcatttttcccacttatctcgtatgtcttcatactttctaattgttttatgttcttttacaacatcaataattgggtcatagttctacttcaaaaagcaagatcaatttactgaacaaagagaaatgccaaagaaaagtaaaagtcagaaggcaatggaattcatgattaccctaacttgctgggagagggcactcaaaccaaaatcagaaactttaaggttcccataatcatctaatagcaaattttctggctgcagaaagtatgtgaacaattagaaatgttagaagtcatttctgattgtatcaaactcaaaataattgtcgtggcacctgcatgtgtgtgtgtgtatgagagagagagagaggcagaggggccttaccttcaggtctctgtggtagacacccctgctatggcaataatcaacagcatttataagctgctggaaatatctacgtgcttcattttcactcatccttccatggtttacctttacaacaaaatgttcattagaacatatacaccactttttccatgtaataaagatggaaagcatgtactaagatccaaaggaatcctatccaccaggaccactacaatgccaatgaatgatgatgataaattgataatcatgattgaatgaatgaacagggatcatattcttgttgccaacactaatctagtatcataagctaaacaggtttggtcgactgcaaatgtgttaaaagagtcactatgtgttcctttttcctccaaaaattctagaatcaattgaaaatagccaagaagattcatttactcacaattttgtcaaagagctctcccccagttacaaactctaaaacaatatatatttttgtcttgcttcccatgacctgcaaaaaaagatgttacaaaatcagaaacagaattaggcaacaaagtaaactgtgctgagaatcaattttatttctattagcagatatacttccttcaaaaatttctgtttagttggatagtatgcactagtacaaatgctagatgacaagcacacaaaacagcaccatcagcaaattaattacccgatggactgataatggtgagttgaagtaatgaaataactctgaaaagaaatacgtatttaacacgtatttattttaactcctgacttctttttttccacatatataaaaaaattcatcacgtgggcaattcatgatagaagaatatctcaagcccagtagcaacagaggattggaaagctttctttggtctcgtttagccttggataaaaggcagcagtttaataataatgattcaagcattccacatatttggaactctccctatgtttggtagggtggggagaaaatgagaagggaaaaatttgaaatttgaattgaagaaaagattaaaaaaaaagtttgaatttttatttctagaagtcaacttttttctccattttctctttccactatctcttcaactaaataaaagaatgttatctgtatttacttttatatcctcccatcgaaatataccataatcaagtgaacaagctaattgttaattttataaataaaaaaacaaccttccaaatcacccaatgattataaatatttaccaagatactttatgcatttcctggaacggtacacgcattaggcagaattcttagtgaaacatacaagaaagttctagactcaaccactaccatctgcagctattaaaaatagaaaaactacatggcaagaataaaataaagaaaaaagtgatttaaaaaagagagacaaatcattgcacgtgtgtggtccacagagagagagagagagagagagagagagagagagagagnnnnnnnnnnaccaagatactttaagcattttttctggaatggtacgcattaggcagaattcttagtgaaacagacaagaaagttctagactcaatcactaccatctgctgctattaaaaatagaaaaacttcatggcaagaattaaataaagaaaaaagtgatttaaaaaatagaaacaaaaatcattgcacgtgtgtggtccacagagagagagagacctcatacaatcgaacaacatttggatgcttgattagtttcattgtagctacttctctcctgatctgcaaaaatacattagaacatctaatctaagagacttgacttcaaagcaactaccaatataaaatactataataagaagcatctgaaatctataacctcccacctaaaattagttcagcaaaaaataggctttgtctggttttggaaaatgtgaagaagcaattgtgttataaaaatttatgctttctaaaattgaagtaataagattaaggggcagagtaagatcccaggttactcaagtattcaacctgctcagccatcttgtgctttagcaccttctccttgtcaagaattttaagagccacatgctctcccgtctcagagttccttgcaaatttcacctttgcaaatgtaccttcaccgatggtcctccccacctcatatttaccaactcggcgcttaatcttaggctgactcattctctacacttgaacttatgcgcacttataaggtgtctacctgaaacgcatatcagaatttagttcctaacaattttttatccacagggtaagtcattcaacaaaaaagaaacttaatccaaatcttgtgtgatgtatgtctaggaaacgctactattgcttatggtttaaaacaagagtaaatagtgtatagacagtcactataaagagtttttaccctatcatttaattacaaactatcatggagtatgagtttctgattggttgacagggtaaaatgaccatgcacaacaaattaaactcttaaaacaaagtagcagtttcaatgtcaaaaggatgcaaagtgggaaacagttctcaatacattttcagcatataccctcaggattagtttaggtccttattctaacaggaataatcaatcattcatgatgtaacccctgagatcccacttttgactagtaatgcagtacactagagagatcttggagaaatttaaaacccattgatactggatttaagttgctgagagaagagaacaattgttgggatgagaaataacctcaaagtctgtcttccagtaaaagataaacccagaaccagaattgagcttgaagatgaaacaaacaggaaaattaacagcacacccctgtgaaatcaccaattttggagactagatttgtgattgtgagaaaaccatcgatgcacaaaaacaaaattgaaggtcctcagttaaaaaaaaacatcatgaatcaccacaaaattttccagcactagagagactcaacaacctttgccagacagaagtaatttattcagcaacaaaaccaattggttggggaaaagagggaattcaggaacttaggatccacccaccaaaaggaaaacaactcaattcaaatctcagggaccccgcaagacaaatggaaattccggtcagacggtcagttgtttattttttgtgccctcaattgaaaacaaaaaattccagaaattcactttgaaaaaagaatgaaaagacagaataaaaagaaaggaaactttacaataattctggaaggatgaacagaaaagcagttgaggtaaccaatatatggcccaaaggggtgctgataatgaaataacaaagcaaaggcagatcaagtcttcaaatttcaagtaccacacaagctgcacaaggcagcatgttatatatacaacaccttgagactcatatgagaagaggatagacatgaagatggaaaaaaaaaatcaaaaacaaaaaacgtgaaaagtgaagagagagaaagagaaggagagagagagagagagagagagagaagaaatacttcaatgcaatctaccgagataagaataaactgaaattctgcagtggaaccaagcaaggttggcttgataattgagcagcttgatgaacagtgtcttggcttttgattatggccaaagggcaagagatttttgagacaactaccaaccaatgctatgcaatcaggcagaactcatgagagagtttcttattttctcattttctgctatttatgctgggaacaacaacttgaaacatctactcatcaatacttatctgttttcatggaatgtatgtctagtagtataataataataaaatatgtgtggaaaaaagagagagagagagagagagtatttctggggttgattggtctgaaccataaaatgacccgtgcatttgttgtggtcacaaatcacagtgccacttgttttggcacatttcaatttgcagaaacaataatgatggattgaacagccaagtttgttttggtataatgtttcaatgtcatcactaaatctgatattttagtactattaccctagttttagtttgtttgttaagggcacggtaagagtggtaagggcactaatgttaaggaattaaaaaataattatattaaaatgtgtaatattatatttttaggatttttttattttcttatatttttatattcaatattcttttaatgtcttaattagtgtttaaaagtaattgttagtaagactctttttttaacgtctttggttacatttatgaggataactgttgaaaatttaatgattttattagagagagataataactgttgaaaatttaatgattttattagagagagataataactgttgaaaataagaatatgacagagttggcatagtaattggggtcaagcagttagttcaggctgtgaaacagacaagttgctttctaaggagtgttataaaataattggttgaagaaaaacgttattttagcaattctcgtgacacattgtaggaagacagcatatgttgtttctactttttaccaaagtgaagtgatataaagaaagataatcgaaatatataattttttaattatttaaaattaaatattaatttttttatatatatttaacatgtatttaataaacattttttttcaataagtattataatatattagttaattgattaacatttgtaaaaaaaatatgaattggactaaatttctagtccatttctgatttaattaggctctctgactcgattcatttgtttactttttcccactcaatgatgtaattaaattttaaaatactaacttaactaaattaattcattaaattatatcaaaatattataaagagatacaaacaacaacattaaaatatcatttatattcatttaaataataataaaaacattttagtttttatatttgacatatgtcaaacttaaggtaaactcaatcaagtgaatccactattggcgtatccgggaattgatttaagttaaatttgagggagggaattactcaattcaattttatcatttttacaaatttatcatataatcagttttttttaaaatcaattataacccaatccaattcaattcatcataaaattatattagtttggttaatgtttaaattttatttcatttagtaaaaaaaaaaaaataggaaatgaatctcctattatctctcctacacacttaaaattatttttaataaaaaatgtaaaatttatgtaataaataaatatgatgttaattttaagaacaaataatctttatatccataaattttccttgtactaattttaatattagttattaaaataaaatgttttttacaaccgaaacaaaatgttgatgataattttttttaatatttttgtggaaaattacttcaaatgggatcatttatgttgtgcagccaatgaatttttatcataatatgctattttatggttttctatgtgtttgtggcacattgtttactattctaatcacgtcctgcttttcagttgcaactaccaaaattcttcattgacttgattaagagcatctccatatattcattttgagttatttatttatttattttttgttaatcgactttcacaatatcacattatatttaatcaactcatacaacattttgcttcagtaatataattttaagtaatccttaaataatccactccttaatgactcacacttaaatgatccaccattaaaataacaatttttttgttaatcaaaagcagcggttgcttatagaaataatattgtctaatatgacacgtgaatcacttgcaatgttaaaaacaactaatcaataatattttaaaataagtaattaattaagcaaagcaacaagtgcctgatcagatactctaaggattacaaaaataatttttttattgttaaaatttatatttcgggtcgccaaaaacaagattatttgggagatattttgagagttaaatagtgattgatactttatgctttaatttgttaatgaatttttaattctcaaaatatttctcaaacaatttaagttgtttggtaagagaaaaaaaaaaaaaaaagagttgacattttttaagttgtttggtgnnnnnnnnnnnnnnnnnnnnnnnnnnnnnnnnnnnnnnnnnnnnnnnnnnaaatgatataaatttagggagaaagtcgaactacagcttcaaaattctttgcatcgtctaatatttagaatcaaattgattttttaattaattttaaaatgatttataatattattatcgggaagttatatgagataatcgatttttcttatatttagctctctggtattttaaaataaaaaaggtaattaaaattatttttaaaaaagaatcatatatttttcttgatgatatgatgcaatcatatattcatcgcacaaaaaaaaagacaataagcatatataaaatattaaaaacattatatatatatatatatatatatatatatatattatcataactcgatgatgcaaannnnnnnnnncttaatgactcacacttaaatgatccaccattaaaataacaatttttttgttaatcaaaagcgacggttgcttatagaaacaatattgtctaatatgacacgtgaatcacttgcaatgttaaaaacaactaatcaataatattataaaataagtaattaattaagcaaagcaacaagtgcctgagatactctaaggattacaaaaataattttttattattaaaatttatatttcgggtcgccaaaaacaagattgtttgggagatattttgagagttaaatagtgattgatgctttatgctttaatttgttaatgactttttaattctcaaaatatttctcaaacaatttaagttgtttggtaagagaaaaaaaaaaagagttgacattttttaagttgtttggtgaaagagaaaaaatgcaggaaaaaaaaactaaaagcctgtttgttttacttttcattttttttttgtttcaaaacagttttcatttacttatcaatcagtttctcatttaaaaatctactgagttttaaaaactattatgaaaaagtgttttaaaaactataaaacagaaacaagttaaagaaattttccttttcagttctcaataataacaaatgggttaagatatcagctggttaaaatagcaagcacactatgttctcaaggagaaaaaaataagataaaagtatatagaaagaaagaaaaatgtcattggcaggaaggttggttcacgggaaggcataggtaagctggaggccacaattgaaaatcaatagctgttttcattataccttaactaaaaaacttaattcaccaaccaaacaactttttctattttctagtttttgaaaactaatgacagtttttaaaaatgatattcaaacacaccataaatttcttcttttttcttatttgattgcataaaaaatagaaggaaagaaaatatatattatatactctggaataaatatatattcttaataaaaaaaagtgtgtaaatataatagtttggtattataatcatacaaaaatgatttttttcctcctttctcttcaaaagtggaaagatcaaaacagtgatgggccacatttatatactttcttaaatagagatataaaatgggtcaaatgattaagaaaaaaggaaaaaaataaaagaaaaaaaattcatattcaatctcttcaagtaacaaaaactaatcattaatatttgttgataaaaaaatatttatatactttcttacgtttttttttcttttgacatttgtcccaaacaaatgaataaatgttttatgctaattaaccataagtaagtgtgttaaactatgattcccttaaccaagtcatagccatgcatggttctctcttaatttcttgctcagccatttttccctgcttcccttaccccacaactcattcaatagcttgtcccattcgtgtggtaaaggtttgttggaaaaccaaaattagatcgaagttcatccaaaaaccaaaattctattgcgcctgtcactgcatgcgtttaacactttaactttaatgggggtggggtcatttcttggtaacttgagtcagttttaatttgtttctttctttccatgggttgacacaccaataagtagaagaagggaaattggaatcttcctcctttgaagaacaaggaattagctctttattctgccatagttcttcgtttggcaacttaaagtatatctaaaatttctcttacttctaagatcatcttgatttttcattttattttacagacagtttaaattaggggaagacttattcctttgtaaagtcactaaatatcattaacctcaacaataatttaatatcatgtgaataaaaagaaaatataagaatataacccaaatcataactagtgtaagcagaaattaaactcaaccagacatgttatactggatatatagatgttcagttactctagtccaacacctgtccggctctctataaggctaaaatgaccttaattagaggcagcaagaggttagaccctttaataatgcttagaggtaaactaaatggtaatttgttctttaaggcccaagaaggttttatttaattacggtattggtacaaactacagagtatttattatttttatgggtgaataatttttgttagcaaatttgactagtcatttttagtgagattttttttatctaaaaactcaaattcaagacttaatttaagaagatcaaatctaataccactcaaattaataacttattgataaaactaaaaaaggtttgtgtatttataaagttaagatcctacatatgaagatcactacacaattcgcatttactatccggtatataccgaacactggaataagagacgaataaaaacaaggagtacgactaagggctaaggagcatagtgccccccagccactgtttgacagcaacatatatgtctgttaaaaaaaaaaatagaagataaattacaaataaattaaccaaaacaagcacatgaaaagaatagcaagtatgcaagatctgccatcaatataaataaaatatagacaattaagttcaagatctaacatatatcttaaaattagaaaaaagttacataaaaaaaaaaacaatggggccaccatgggatcgaagaagttggacggtggccctactcttgcactctcacgaaaatgtatcaaacatttacttcagaaaattattttgaagacacgaaaaaaaatatgcaaaattagaatgtggagttgtcacaaaaaaaaagtcggataaaattaaaatatattctttttgaaaatatatcgaatgcttgatcaagaaaattgtaaccaaaattataaatatagttgcatatacctccaactcgaaggaataaaatttacaagatgtaccgtaactacgtgagctttaacagtgcatcgcattaagtctcgataaatatagatacgatacaataaatattattggtactaactttttatttaaaatgatatttattttgataattttttttatctcattaattaaaataaaactttttattaaatgaaatattgattttgattaaaaattaatacttaaaaatatatatgaccaccaaaaaaaatactttgaatatatttaatgtgtcttaagttttattcatcttatataaggcttacatcccatttcattttccgcgcctccttaaaaaatgcaacattccaatttccaccccaacgtgatatgatctgaaatttaataatacaagtaatattacttagttgaatattgatagagaagaattaaaaataatttatcccaggtactatgcaaagtttattaatgcaagtaatattttgtagaataatttaattaaaatatactaattaaaaatataaagatattttatactgttttgatcacaaattattgtatataaagtttttcaaaagttgactacttcaaaaattattttacataagttactacttactagtcaacagaaatttttatgacaatctatttcacgtgcaaaataatttgtaatataatacaacaaactatattttatgattaagaaaaaaaaaaaaaacactatgactattgaatccatgcaaccattacgtcaagaatttttgctgatactcgattgcacatggtcgtcacatcctcaacctttgatttaataaaaaataataaaaacttcgagatctgttttcgtgattttaatatataaggttaagcgtttatatgtacttattgcatgttatgcgaacttaggagatcgatccacctcgtatgagtctcttgaaaatgggtttgaaatactaaacgtatggaacaattttttgatagattagggtgacatgcattttttctttaatttcttaaaaataatgctgttaaattgccttcttttaatgatttatttatgagagttggaaataagaagatatttttttaagacttaaatatttataaagttacttaaaaatgatgaaattttgttatgaatttttaataatttttttttgttatttcaagtttttgatatattaagactcctgtgttttgagtctctattattagttaagtgatgatgtattattttataaatatagtctgaacttcttaatattattaatggttgtgatggtattatgtcatcacttaacatgatgataataatttaacaaaaaatttcatatattaagaattcaaaacaattttttttatcagaagttaaaaaaatcaataatttagtagagatcttaaatatttttttttagagaaaacaatgatacattttttaaaagaaaaaaagaggggtcagattttttaagatcttatatcgaacgcttctatattcacatgaaataaaaaatatattaaaagttaatcctttgtatctacaaaaatgttattatatcaaataaaaatataaatacatgattaaagtgggttcaaatattacaacccctaatcaatcaattaatagtttagatttgacttttctaaaattatgaaagttaaaatatgtaatttcagtcgttgataagaaaattaatagtgaatattataatatatttatgatttattatatatacacattaaatcaataattattttttattcaacaaataaaattacttctttcaatttagaaaagccgaatcctaatggtttagagccatcagcaatacaatttggcagccaggctccaatagaagttagaacttggaaccagtaaaagaaaagtttgtttacgtctctagaaattcaaaattttccattcgtgtgggagaataattgttttctttttaaaggcaaatttattaaaagatttaacccacaaggtgtgttccaaaaccttatcagaggatacacatcatgtttacatatagtaacctcaaaaaatcctcacaaaaacttctcaaaatgagaagcatggaaaataaaagctcaagaacaactactaaacaaaacaacacgatatgcttattcgagaggaatgattaagctaatataactctcagtctattttgtctaaaaagaaatctcagtcaattaattcatatgctcaataataaggcataaattaaattatatcatcacagataaaattttgatcttaaggtaaatgagtttttgaaagtaaagggcaatatcaacttttttgatacgtattattagattcgatttgaaatattaattctgaatttaaattatacttcagttcttgaaagttctattctcaaatcaaatactttaaagtttctctcttctccaattgcttaggaactaggaaggttctatgacagttagcgtggctaattagcacacttattattaaaatgaaatgcatctttcaagtgattattatcattatttttctttcctcgttaagtcacgtgttattttttaataaataatgatatgtcttcttgcaaatttcttattattttataaaattattaaataaaagtaaatatttttaaatgtaaaatacagtcaatatttgttataaatataaaaattaaaaaccgagctaaaagaatttaaaattacttttttaaatttattgtagcttgttgaaaaattggtgattgaaacctaacttgcactgctcacaccgttccccactaacactcattaacttattgacctcttcagtgactgagatttgtatatatattttttgttaatgactgagacttgtatggacgaacgacactgctatattgctagcactaatatattaaataggagtctcctgcattattgttgttttgcaaattcataatattattgatattggggaaatgaggacatatttacaatctaatgaattggtatctttttataaagccgtgacactattttttttttattaattttaaataatgggcattagagaattctttaagaacacgtaacattattggtttgtcttaatcaaaatacatccactaatttttcaataattgaatgagttcatctatatagtaacagttattttttttggacagattagtaacagttattaatattttttttataaagttattactatattgtgcattataagattaccttttttaaatattattacgattaggaagtttttcaaaaattgctttttccccccttaataatttttcattttcaattgctaatttgttttggattacggttaaggttcaatttacataatgatctactttggtctacgttggattaattcaaattgtaagagtcgaagttaacatcaagtataggccttctaatatacattcgcgaatcataaattacacattagtttgaagcaaagttataatgtcgcgaatcataaatattgaagcaacatccaaaaccagtttaaccacctgttaacgagtttcaactataactaagtcctatatcatcaaaatcaactatgtagtgcatctacatacatttgatttatagctgaaattaattgttggtgcatgttttaacaaaattcaatggataaaaataaatataaataaaaacaattttttaaaaaatatttttgtctcaaaaaacacttttcatcgaattttcaaacatgctcataattgaataaacagcatgtaaaatgaatgtttacatgctatttatagagtttgttagtagtaataataacaatcagcacaaattaactaactaaccaatttcaacgaaaataaatatttttttcctaattataaaatccctttaattaattcatgtcttttaaaaaaataataattattttcttatctttctattcacttaattatttatcattaattctggagagaaaaataattaagaatatgtaaagaataattaatatatctaaaaattgaaaaaaatctataaataaataaataattttttaaaaagattttataataaaaaaaatccactaaccgtacgaaaaaaaaaacattatacagtaaatctcgtgaggctagttcgctatactgcaacaacgaagtacaaatcctaataaatgcaataatatcgaacaatcatctaatgactgcatctaacagccaatctattttacacgatgtccactaaaattggctctcacacgacagctgcactaattgttgggtcccagacacgtgagtgaaaataatggccatgttcctatcaactccttaccaaaaattcagaaaaagagcaaagcctaaacactgtaccagggtttacaaaattgttcagattgcttattatagagcaacttcatgtcttacaaaaaatatcaaaaccggcctcttagatttagggtttaattaaatattgtgtcttacgtacatattagatataacacatcgttattatcatgtaaagataatatatgaacaaagtaaatttagcataaatttcactgtttccggaattttagattatgtttcaaaagaatatgtaagatccatgcattgatagagactatcctcttctagatatatcatgcatatatgcagacctacacaaatagatcagatctaacaaactcttcgtacacctagagccagcataatgttgttgcagtttgggtgtaaataattaaagtggaagaaaataagaagaagaaaaaaaaaactaaatttaagggaagagatacaaaggaggaaagttattttgataggactcaccacaaaataattttattttaaattggaattaaatgagagaggaatagtctttctctttttcattttctagttaattttaattaatataaatattttatataatttatttatttttcattctctatcccatttatttaattaaaagagcaaaaataaatttttgcacttctttccttcctactttaattcatctacattttaattataatttgtgtctaagttacattgagtagttttttttaggtatacattgattagtcttttttgatctaaactacagtacacatgtattttgtactggagagattaattctattcgagcatataattgttaaaaccattatgggagtaaggttctccatctaaatatttaatttaactcgattgtatattcaggtctttaacgtgcttaatggtgaatcatatataactcatctattagtgaacttacatttttttttttttaattttacatttttttggaggcttttacttgaagaatgnnnnnnnnnntcgaacaacatttggatgcttgattagtttcattgtagctacttctctcctgatctgcaaaaatacattagaacatctaatctaagagacttgacttcaaagcaactaccaatataaaatactataataagaagcatctgaaatctataacctcccacctaaaattagttcagcaaaaaataggctttgtctggttttggaaaatgtgaagaagcaattgtgttataaaaatttatgctttctaaaattgaagtaataagattaaggggcagagtaagatcccaggttactcaagtattcaacctgctcagccatcttgtgctttagcaccttctccttgtcaagaattttaagagccannnnnnnnnnattatatatatatatatatatatatatatatatattatcataactcgatgatgcaaacaaaatcatctacacactgatttgtagctttaatgacataaaataagcacctcgagagattattattgtataaactagagtaatatttaatctgtttaatatgatttgattgacccatttttttctttcaaaattcgaatcaagttaagtcaattaaatattatcggttcaaacttgattttacgctaaatctaaactaaccaatcaatcaatatacgaacactcctagttgaatgtctagttttcaattggataaccagtccaatttttacggtgtaaattaagacaaaaattggaggacaagttaaaattcattttaaatttgtgagaatttttcaattagaatatttatttgtctcccattgatggtttatgtggttacgttggggcatgtggtttgaagatatctttataaaaatgagaacttaattatagaaaagttatatgtgcaatttattttaaagaaattgaaatagatgtacggtttttcattggaccactgaactgcttctcgatctggagttgttttccgtgcaactttgggaccgttcgtttgattaatcaaagatgtgcatgcataacattaaaaaacaatatacgtacattttcgtcaaccattatctgtttcggcatatagggaatttcattttgaattgtgcttggcttttatattactaagagaggttaattggtaagcaattttatatacttgttctcacatgcaagaaattaagaaccgaagaatattccatattcccctcggggggaaaaaacaaaaggaactgggcttgtggtataagggtagaattcagttttcaaatttgttctggtctgcacctcaagagattatttggtgtgacatggttaggagtttatttctggttttgtgcatatgaacaaatatatattaaaagatgttacttttttaaatgaattttagtattttgaagaatttttcattgattctcagtagagaaatacaatggccaacaaaaaaaaataatgatgtgttacttttttattagtttaaataatgttgtatcacatcatttttagcaaataaaaaaataaataaatttctttgaaaatgaaactgtggagtagagaaatgatgtcatagatatttaaagataaaataatagtaaagttagttttctaaatttgttatacattttttatttttaaaaatttgtgtaaaataaaaataggacaacacttaatattggacgagttacataattaatattatttattgatgtggtcgaggtggtgcaagatgcatcaattattcttcattgaattttacgggaaagttcccatattaatatgcattcaatttcccgtatgtgaggaaattaatatttttttagtagtatgaattgaagacgttatgagaaaatttataataactcatatattttatttaaccaaatgagccgagctaaactatgggataaaggaaaatgttaaacgtgccttaaaatttttatagcacaagatttattgatttcacaatttttgtgaacacttgagtttctgctgctccgcaaacgagtgcccatacaaaaagtgtggacaacatgatgctattgggtttggatgtatgtatgatggttgcggaatgtttctttcacaccctttttcagttttctacacttcttttacattctggtctatcttaatttcacttttttttttttaattcaacattccattactcttttgcattttaattcatttacacgctgaagcagagtgtgaattccaaaaagcgagagattttatgctctattttggatgtaatcattttcgaaaatctatgctctataataggttgtggacatatgagtggaatgtgggccttgccgtgtagtgttgtgttctgggccttttgttctttgaagtgctctgagtctgactgtcaacttattagatatcatcctaaatatgatttttaaaataattattatataagtcaataaaattatcatgagatatgattagataatatgtagtatttttttatattttcaatatattttaattcaattcaatttttattgagaattaggataaagttacgattaaaatcagagtgtgtattgggaagtaataacatgttttcactaaaaattatatattttcaattcttttagtattatcctcaaagtacttcttagcattcttagtaataagctaaaatgcgaacttcaaaatcagcgagccaatctcattgataatgagattaatttactttatcaattcactggaattagtattttcttaggtacatatatattctcaggggacggatctaaaaaaataattaaatgagacactaatggctgtcatatacttagtagtagggattcgggggcagcactcccttaattttttttataaaaaaatttaaaagaataaacaattataaatcataatctaaaagaacaaaccatgaattttttaacattcacataggatacaaaagaacatagaagtatatatatatcatatatataaaattataaatataaatttgaaaaatatatctagcatcagatatttaaaatgttaacttgcaagcaaaaaaaaatattatttttattgatgtacaaattgaattacaacttacaagaacaatactatctaaaaataaataattataatctttgtttactgaatgaacatgttatccttcatagatcaattttatttcatttggtaatgtaaaacctgtcccatttcagtgtcaaattatgccataagattacacacctttttgacaattggatcattggttgatgaagtcgaaaaatgttaaacgtaaatagagatagagaaaataatagatatttttaagttatatgataaacaaatagaaattagataaaaaaagattaaaattcatatatttataataatccaatgaagccaccctcgacgtcactttagcaattttatttggagaaaaaagttttattgtctacaatcttgttaacctcacgtatttcaagggctagctatttttggtaatataaaatcactctcctatatcaaagaggaaactaattggtaggtcaaacggtcaagaacaggtcaagtgttgatttggtaagcttataaaaataaaagtgttgattaggtaattaaaacaaatgaactgccggccttatgattttattctaccaaaatgaatatcttatgattttattctaaccttattcaacacaatacaaaaaaaattcagggagttaaagtcagatataatttaaattttggacatgtaattacattaaataattaaagaaagaatagttaaagtcagcacaagtaaaatgtacgtaacattctctttgtctcaaaataatttaaattttggacatgtaattacattattaaaaaaattttgacaccgaatacactattttcttgtatacataaatgcttagtcatttcacgttcattttccatttgtagatgggaagggactagttcaattcaacattgcaaataagaatgcccatgctacttttttgatgatgaattcttaaacgagagactaacaatgggttgagagtgctagagcttcttctaagacggtttagagatgaagtcaaagtatgacacgttcttcattaattattcatcctcttgaaaattaagcactgtttataccaaattcaaattttttcaccctctatacatggtgtctaccatccacataacaatgtaacatgctttctttttcatggcttgatgctgtctccggaaacacttttcttgttttaaaccttttctacaaggtgttgttaactaatgtctttataacattgagtaaagaattaaaaaattatattgtgaaaattataaaaaatatataaaaaaagttataaatatttttttttcccttaactaataccttaagaatattgattaatatttttctttctacaaaaactaatggatttaattaagggttttattaaccaatacctttagagtattagttaattaaagaagttaaaaaagaaaatatttattatataaatcataaaaaaactatgaataacataatttttcatcttttaataaaatattttcttttaaatatcttaaccaatatttttaggatactggttagtgtttttgtttaattaattactttcaaacatagctatcgtcacattccttgcttgactctatgcggacactattcccacaagagaatatgctgtccccaaacaaagaaccaaatatttgtgagacattctccatggttcacaaggcagcgtgggaaaaacttggcattttcgtaggaaaggtactaatgctagttggagagggttcataaagcatggtgaattaataaattgtgtaatcaagtttttttttagtgatatccacctaaaatttacttcttctacactcatatataagaaaaagataataaaatttacacaaattaagaaagttggttgacattatttaattttattaatcttaaataaaaaataattatttctaaaatgtttttcattgaaatttattatcatgaataaaaataaatcattgaaaataaaattagaattaaataaaaagtattttaagaatgataatattaaataggataaaattagttagatttatttatattgatgttaaacagataagattttttttcttctcatgtatgagaccaaagagaataatatttaatacatatagttacgtcaaagaatatggttttggtacttttttttccattatttatcttaaaagttaaaagagagacatgtgcaatttcaaagaggttagatgaaacttcttacaatttgattatacgtacgaattctttcttaatggaatcaacaactgatagaaagttctcgtcacccaaatgttactttgaatatgcatgcaatcttgaatttttccaaacttcatgttcattccttgttgttggactaaaaaggtttaatttggatatgcaactaaagatggtttaatggcactttgaatcccgattcatttgaaaataataaaaaaaaaaaacgagggacatatgtctaattccttcgtccatatgtaatcatgttcacatgactctcgatttaagaaaaagaaagaagaaagaaaaaagaaaaatccttatcctcatttaataggggaccattatttagtgggggatcattaaatatcgcggtcatcgaaagacaccacacggtaatgaaatgagaaatatttgaccaagaaagttaaactgcgacaaaagaatcacagaaaacactcagggagaaattatcaaccattgatatatacctgacgtcaagttacatgataaagttcatcaaataatttaaaataaaaaaacacttattacaacaacataacaaatcagatgaaattagatagaacatgacaaacaaaatatataatattcataggcaagacattaaatcatcggttccaaaataaatatcccatttgaaaaaataattatcccaaaatagatgttatatttaacttttcattatattttttttttatcaatatccctaataaatatcattttagtttttaaatttaatattaacactacttttatttatttaataaaattagttttttaaaattattactctattttatttatttattattatttttatctatataaaatagtacaggataatatttattttgggccaataaaaattattttttaatttaggataagaaaatactacctatgatctcatatacaaataataaattatatttttctttggtactaattataagtaagaacgatcaattcttaaacttatttaaagttaaatatcttttatatatttaatttattgttaattctatttattaaatatctactcattagactatgaatattaatattaaataaaatcattatttattatatttaaatttaatcatcattttctttttattttgatgatttgtattatgttgtgaaacttgttaggaaagtagtaatacaagtaataaatatgccttcaagacaaatttaagatacagtgtcattgatatgacaacaaattaaacctttgaaattttcaatactaataataacaataatagtgccttggcgtgtcaggttgttgggaagttggctattaaatataaagcctaacaatatattttgtgatgttctttttaattattattatttttatgtggaaactagtaaaaatttattagagactaaccataaaaaaaggaattatacttacacaatttcgtcattgcaaaaatgtgtgtgtatattggagtatgttagaaaaaattataccattgctgtcaaatgaaatattaccatttactagttgacattctttttccaactttcaacgtcacgttggcaattcacgcattaaggaagttgtcgtgtgcatgaacataagagtcaaaatcttaccaatacttaataaaagcaggtaggattttagattttagagcctggtttggggcgcttggcccttacttcaatctttgaagagtcaacgtgaacaaaacagttagtttacattggttcaatgaataacaattgactacgctatttcctcagttaccccttgcttcacttctttatccaaaggccatacacttggcattttcttcttacttcttcccagacaaacaaatacttacaattttggagaaatttttcatttcattcacacccttttcaccattggtgctgttttggcctgagaaagaaaaataaaaaactttcatcatgggaaactcctgcagaaaaccagtggctcatgtgtcttcagcaagtttctttggtcagttttaatttggttactttaaccatatctatatgactatataactttttctaatttatcttttttagtacaaagtataaagccttcaattgtttttcttcaacttttctgttatcatcagttagcacttgtcatgccacttaggttgatgatgatgatgccttaaatatgattacggtttgttatattggatgattttatttctctctctttggtatccacggagagaagaagaaggcgatgttctcaaaatggtaaaggttaaaacaatagttcataggttgtaacgtgaaagattataggactagctagtcttgaattgagcttcttttgttttcttgtttgtttattgttctcaagtccttggcttcctaggattgaattgaatttttgtcttttgagtaatttatatataaaccttctgtattgtgttaatattggcctgaaaaaatggagattatgaggcttcgtcgctctgaatcaggttctaaataatgttgaataatttttgcttttttctgttaatgcagttgctagtgtgtggattgaaattagctgcattttcctttggctattttttctttcttttcaacaataaggcactgtttgtccgaatgagctaattgtatgttactggatgtttgtataacatctccctcccctttgcttgtttaaaacaattcttgtctatcgagaataatgtaaaaggggttagtttaatgatgaaatgcgttcagcaaaaaaaatttcaatttattatgttttaagtttggaattctaatagcctttggttgtttttcattattgttcctatattttgtgcatgcagtgtagcaaaaatcaattattcactctaacacttaatgtccatatatgcttgctcaatcaatcactcttttagcacctcgtagctagtaatcaacttctagatgccacacgtaatagtgcaatcttctgcactaggttttagaagttactccaatggctgattgtaacttgcatatcatctactctcaggaagcacaaagtgtcagagtaagagaaaacagaactcaaattcttctgaacgaaaagctcctttaaaaacatcagcatcaaaagttgacaatcccatttccaatagccttaagtccttcaccttcaatgatctaagagaggccactaagaacttcaggaaagaaaacttaattggagaaggagggtttgggtttgtctacaagggatggatagatgagaacacatgcgctccaacaaaaccagggactggaattgtagtggccatcaagaaacttaaaccagaaagctttcaaggccacagagaatggcttgtatgtccaagtccaacacaaactcttaaactgttttctaactgcttggtcttgctaggtgttgactaattttcttccctttttgtttgcaggcagaagtcaattatctaggccagcttcaccacgaaaatttggtgaaacttattggttactgcacagatggtaaaaacaggcttctagtttatgagtttatgcagaaaggaagtttggaaaatcatttattcagaagtaagtagtacattcactcttcaacaatcaacatatctagtctcaaatgatccactgagtacaaatgtacaaatgggtggaaataggataggccagacttggctatggtaggcctgagcccgatttggtttataattacaaagtctgtttgacttgtaagcctaaaagtccttcaaaaaaatcaattttaataataatgattttatatttttattaggtgcaatttgtagtatatgtataatgtattatgtattatttatatataatgtaataatataatataatattattatgtttataaatagaccgacttatcagacttaataggtttctttaaagcctggaacttgatattttcactaaaacagctttttataaagtctaagtctaaccttttaatatacgggacaagcttgacaatgccctgaaccataatttcttctttattcacaatacctcaatttttgttttctattactgcagaaggtgttcaacctattccttggattacacggatcaacattgcagttgctgttgcaagaggattaacatttttacatacccttgatgcaaatgttatatatcgtgatttaaaggctgctaacatcctacttgattcggtatgtcacactgaaagtttggcttgtggatttgggaagaaaaccacacctgctgttttgcatgtaaatctccattctgaaagagtagcactattatttatgcaggatttcaatgcaaagctttcggattttggcctagcaagagatggtcctactggagataacactcatgtttcaacaagagttattggtactcatggttatgctgcacctgagtatgtagctacaggtagatttgcctttccatttttctttatctttatcaaagtgttagtttcttagcttttggatgttgaggtagaagcaaaacaaaagcaaggagcaattgagacaaaggaagatgcaatcatgctgtgttatactaataatggacacttgtgactttttttaattctaaaaattcatttggacaccaatttgaatgcatcctagttcactacactaatttcttagtccttggtataagagacctagtgtgtgtttgggaatcagttgaatacttgaattcaacgccaacagactttcacatgaaagctagtacaacttagttgcgttgaagtttttgcattggaatgtgcaatttctccatttgacgtggtttcaacgctaatccaaacacaaacctcggtaacttgtctgtaaattcttcttagaggtcacagctcaaaatgaagtaatcaaattggccaacattttgaatgtttggataaccatttcggacctacttttgggtgttgaacatacttttggagaatgatgctctttatttgaacgtaattttaaaaggggtgaacggtgatccaaacatagctatatatgttattatatatataaaaagaaaacagaaagcaaatcggtttatttcttcaaaactcttgagtactctacacataagagacaaaaactaaataatgttccatttgctgtgatgttatgcacatgatttgtaaagttgatgagcatatatttttcccatttataataagttgctttttgaataaacaaacaggtcatttgaccccaagaagtgatgtatacagctttggagttgtgttgttagaattactaacaggacagcgtgtagttgaagatgatagacctggattttcagaagaaacactggtggattgggcaaggccattcttgagtgatagcaaaagaattttgagaatcatggattcaaggatgggtggtcaatactccaagaaaggagcacgggctgcaggagcacttgtactacaatgtctaaattctgatcccaaatatagaccaactatggtaactgttctagcagaattggaagcactacattcctcaaattcattcccaaggaccccaaaatctggaactgagaatcatacaacaaagcattctagtcattcccacacgtcagctacaagtagtagtaacaaactatgagctgttctttctctatgtggactaatgcttttgcatcacaacaagtgctttgttctttcagttttgcgactaagtgaataattttcatctagggcaaagcattattttattttcgggtcattgtcggaaagcattaccatgtaaacaacggggaattattcatgtgatatcatatgaattgtttcaaatgtgaaacggtagtgttttgttaggagttcaaaagggtatatagttagaaaaaccaaaacttgtaacttttgcaccgttgtattcatatccatgtaaaatcacataatttttccttcatattaatcatcgtctctccaaaatgagttgtaagtttctctaaaatgtttaaaatttactcagacatctcattaaacaatgcttggttgacgtaaaagtaaccttagaggcttagacaaattttacttatgatatctctattttagacgaagacattatttccaacattattagttttctctaaaacaaaaccattgttagttcctttggatttttttatcctccttttttcttaatctttatgaatgaatcttcctatgtttccgttcatgtttatgaagaaagacaaaaacaagtataataaaatgtttagtaatttctgttggatcgattacattttcctatggcaatgatccctcttatattccttctatcatcacttgcatagcaaccaaaagaaaaaagttaataaaaaccactgatgatcacaatacatcgctatggagataagaacgtttagaagcttgcagaaaagtctcaatatatataggaagcaaaattggctctaggcttaatcgttgaatattttcggtcaccatatcataaagggaacaataagttacaaagcagaatgttttgttttactgtgttgggaaccagaatatcaatggtaaaggtaactctatacaaatataaacctcggtttagtctgttacaacttacaatgctgcaatttaagaaaatttaaagaaataaaactagctccttacaagatgagcaatagaaaaataaataacaaattagagaactagattcttcactcattcttaccaatttcctcatacctcctattcggttatcacacccatcatataatcccctctctcctctctctctctccttgccacctgttattttctctccttaaaccacatccacatgttacactcctccccacttctgcctgtgtgcaatttgtttattttgtcttccataatctctcgtacccatattcattaatttcacttccctaccactaccatatccatatatacagtgcatatcatactatagtgtaaaactacataaaacaaaatattgtgcaaggcagtatcccaataacaatatcagaaagcagcagcttgttacacattttgaagtatgctgctaacattcatacatactgcacaggaatcaatgtatatagtgaagaaaaagaaaaaaactacaaaatcggaggttcactcttctcttgtggtgcccttgtaataaggagccccaaacattacctaaggtgcatgcatgcatcataaaagtttccaagcacttcaagtaatgagaacgaatatctcagtagtatacaaaccatagaggtcatatctcatatcttctcagtaacttgatccataaatagtctggtccttctcaaatttagtagggtattgccaaattgtagtactaatactgatcatcataagtatatttactgctgccaaccatactgttgttgattgcggtttccacccatcatgttcgagccacgaccagccgctgagcccgcatatggaccaccttgttggggataatttggagctccaacatagccactggcaccaccgccacgaggaccaccaccaggcatactattggacccataaggcgccccccgcccttgaggaggataagatccactgccataaccaccaccaccttgacctcctcgatttgggtgattgaatcctccacctgggttcccattgggaggatatcttccaggcccaccagatggaccccggggcttcccataatgatgcgtaggtcctgcagcaacttggggttgagaaccatgaactggttggtttggtcctgatcgcatttgggcatgttgcccaggctgctgaatggggggaagacgagtgtgaggctgtgggtgcggcattttctgacgcttagccatttcttcattttgccgttgttgttgtcgctttttctttgtctgaaactcatgtgatgattcgtacttgggtaaactaagccatacagaagagaacgaagttgaaaagtattgaccagaaaaggattagttgagtagaaacaataaagtaaaaaggaaaggaatcaatgagacagacatttaatccttttaagatcacataatttcaaagtaacattctcaaaataaataactaatgtacatggaaggtctaacctcttgggatcgcacggtaatggatctgtccagaaatactcagcatcaagtgcatcttttgcagtaattctctgtagaaataaaattgacaaacaaatattatgatgcagatcataaacaaaattaatcatcataaaaccatgcagccaagtgacaaataataatttttttggttacatttataaatttaataattatttttgttacaataaattttcagattacaccaagaacaacacaaatttataaatgacagcacaaagataattacttaacaaaattcgtctcaactagcactatgccatcaatgttcaccttacataagtttctcacaaaggaaaacagatgtacaatatttttctcttaagcttactgagatttttgtcaacatacatgatataattaataacaaaacaattgtggatacagttaaccaagtaaaattaaaacagattgaatgataaaagataaaactggaaaaacaggtatttgaagcacttaaaatagaaattcaatatcatttaacaattaataaatcagacttataagtgaataagtgatacctgagctggatcaagtgtcaacatcttctccaacaattccagagcatgatgatcaaaactataagtcatggggaagaagctattagatataattttttttctagaaaatgaattacacgctaacttctttggtggataaaaaagcctatctactttctgatacttttgctttgatacttactgcctgaaaacttccctcaaacgtcttttcatcggccttgttggcataaatttattataataaggtatcttggaaaccccaggccaattgacttcatttggtgctccacacagctcatatattttatttaattgttctggctataatagttacaaacaaaacctgtattacacttaagctgtacgaaaaattatcgtgaatatatacagtaatgacatgtatattaaaagaaagatctagagtgaatgtaatgactaaataactgaaaactatacagcaggtttgatccagcaatgtacccaaacattaacattccatcttttcttgacaattaaatataaaaattgtccccacacataacactgtttttcattttagtttctgcatggaaaaactctacattttggttcctacatgaaaaatatttacaaatgaaaacctgctatttaattaagtattaaatttggaacctatactagacactgttttttgtttgttcttataccaaaaataaataaattacactttgtcttggttcctatatgaaaaaaaaaactacattttgatctctacacctgacacaccatttttcgttttggtccctactccctacataaaaaatctctaacactgtattaactttagcaaacgacagaaaccaatttgaaaatattagagattatggaccaaaacatagaattcttacagggactacaatgaaaaacagtgtcactcacgaggactaaaattttaatttaaccaaaaattaattaagcaaaatgcatatattcaaaatcaaaatacataaacatcattgacctcctgaacgaaatgacattttccaagttaaacaattaattagcttggcacccgaagaaagcaatcaatgtaaagccatttaaatgaaaacagaaaggttattttatgctcgtgggtcgtggcaactaggctaagatatgtttacaatatgcagtaaaataaatatggcagcacatgtcaagagatcgaatatgaagagtcagaatgtagagaatatcttcttgcagccatttacaagataaaagttaaaaccatatatagcccataatcaatatcacaacaatcattcatcaatctagctctaatttctctgaactatcatacataaaacatcacttacctcatcttttccaggaaagataggcttcccttgaagaagctcagcaaaaatgcacccaacagaccacatatccacagctggcccatactttgttgttcctagcagcaactcaggtggtctaaatatagccaaaaatcaatatatgcattggccaatttgataactcatgataaaaaaatgacaccaattacctgtaccataacgtaatgacacgattagtaagatttgcattttggtcattagaaaatgatcgtgccagtccaaaatctgcaagcttaagatttccttcattgtctattagaagatttgagcctgcaacagaacaaaatacatcaaataggtataataatagatttaacattctaatgtaaaaacataatcttttaacacagacctttaatatcccgatgaagtacttgatttacatgacaatagtgaagccccgtcaaaagctgtctcatgtaacacttaagaagggaaacacaactcagacaacaataaaatgaacaactattaatatatgaaataacacttggtattaacagtaataccttaatttggggaactgtaaatctcatcccaggccggtcagcaagacctgttaaatcatggtccatgtattcaaagaccatatagatgccacctttatatttgttaccatctgcaatccccaaaaaaagaatgaaaagcagatgaactaagtttagtatgcaaagcccaaaagaaattgatggaatcatggaaatattctcaccactagaactataaagcatattaagtgttactgtctagaaattggctaattaaacgagaaggaattacttgcctggcttcccctgttcatctttctcaggacctgaaagaaataacccagttttatatataaaacaaatttttaaatcctaaatcttgaaaaagggtacctgtatcagtcacaatttccttcagcttgatcacattttcatggtgtagtttctttagaattttgatttctcgtatagcagttataggaaactgcaatggcaaaaatttacaatacagttcagaggagcaactgtagcaacagattttaactgtaacttccgatttaggttcactgaatagcatgtacagtgaaaaaaggttgtaaaagcagaggagactaattaggaaagcatacaattggaacaaaacacaaataaaatacattatgcacccataatgtaataaatactgaaatattcaaatcaaagatataccccctctctctcattgtccattcgtattttcttcagagcaacaatttcaccagttttgatctctttagccatgtaaacctgactgcaagcataaatatattaaggtatacatcagttcacttgagaaagtatcagcaatgaagtgggaacaagttttttttttttttttttctctgnnnnnnnnnnnggggaaaattgcattgctatgaacaaagctaaaactagatgacattttaaaggtgtgatggagttgggaactatgtccaaagaagaaagcaatgtggcaaaaagtactacttcagaaacagacaagagacaagggaacacaagacaccaaattgcacaagatgaagatataaggttggtttggtggggaagggagaagggaggaggggaagaggtcgtgggttcgaatatcctactaacaaaaactaacaaactaacaactaacaactaacatcaagatcaatatcaatagcatctttaacccaagttaattggggaaactaacaactaacataagactaaaaaaaaaaattgcacaaacagtcaaataaaccataaagaaccaatcaaggtttttaaaaacagctcgtaactgcaattgcagccacaacaccgaggttttaggggtctctgcaaccacatcacaagttcacaaccacaattgcagctgcattagccacatatgtctataatttcccacgatatcaatgatcgccattaaacatgaatgcaatttaaaaccttggaaccaataaataataataatttttttaaaaaaaagatatacaaagcaattaaacctcaaagcatcgaacaatagataactatgatgatttctccaccgataaaattttctgattgataatagctacatgataaagaatcaagagttctaaaaacctcacgtttaagttgttttcaagttcaacctagcccaacagaatctctccaataatcccaatagagtgttgcatagtaaacacgtataatagttaccattgacttcataaattttcatctacatttttcacaaagacaacccaaaataaaaacttgtttttgataacgtaaagcttaagcagtagagaaattgaaagaaacccatatgtgccctcgccaatttgctccaatttctcgaagcaatcaacacttctggatccccaaatgggtgattcattcacgttcagatgccctggggctgcaattgccattgctccctaatcttccaaggaacgaaattcgaaggcaacagcgaatcgaatgaatcagggttcctctagggtttctggcgcgcgaaatttatccagaaaatctctcacaaaatagataagctgatatttgattgctttaaactgaaaattctagtttagagaaaaataaaaatgtgtgatcattgaaaaagaatatcaagattatgatgttcaccgtacgattcgctcgtaaattcgatttcacccaattaggcttttttatttgggccgaacccaatccaatttgtttaaatctgtttatgtacattgggtcacaggttttatttttttaaccgtattaattgaatttatcttttagttgttatccaattttattgtacaactatttctatatttttttatgtatacattacaagtcaatgaaagacattgacttttctattattgaaatcaattacttcttaaacattcactaaaatgtttggatgatgcaccaagcaagtgccaaagactattattagtgagaaatactaagattaggattgatctaatgaatgaggtttaaagtaattttaaagagattttttttttactttaaataatagtataacatattagttctttttgtcaatattatgatatattttgtccaaatatgaggtatttttgctttataaaaattaataaaaatattttttttatggacttaaaaaatttgaactttaacatatttagccttggatcgatcttaagttcttaactaaggtcacatccacacacactctttgaagcacacttcttttaattggatcaaatcatcatattttgaaaactaatctcctgttcaccaattgtttaagttttgtgactttatattttcttgattttgttttattattattaagaaccaaaacattgtctacccaattatgcagcctcagctttgatggtaaccctcagtgcaacctcttcccttgggcagtgttttgtgtttgacaggagtgtgtggatcaccataaagaggttcaactcgtaagcgtagatcgtgaacgaacacactcaacaacttctccatcgctgcaaccaatgctctgcctccactttgcttttaccactgtcatctttggtacttctaacttttcaaaatggaccataaagtacataggttgatagggattcacgttttggggaacgaggaaagtttcatgctttagcaagacatatgtttttactatctttaatttcagggttacatttttgaaaaaaaaaaaaaaactttggacctttttgagtccatcgttttagttcttaataataattaaaaaaaattacatagtgagcaatttaaagaatatgatgatatgattcaatagaattaaatgtgtgaaaactaatatttctctaaaagaaaaatactaaaaaaaaaaatttgcagcaaaaatgcctcataaaattaatatattatgtgacaatataaaaaaaatactatcacataatataaaattgcctctaccgtaacaaattttttaattatataattgattaaataatactttgaaatcttttttcaacacacttatgttagagagaaggtatgggcatcttcaagatttttcttttagaaaaataaaattatgaaaaaatttagcctcccgtttctatacgattatttgtttttaaagtttaaaccccaccaatatattgataaaaaaaattgataataaaaaagaaacaccaatacaatccttgatggtcaataatataatgtttggcaaagatagttgactttgactttgaaacacaattcccatttgttttaaggcgatgataccactagtctaattttcatataaggataatgggaggaataccatcattgttctctttattctttagtttaaagtgacacttcattagaaaaagttagcacactaaaataataagtgatgcatttagttgaggctctatgaatccagtgcatttctataaagtcacatggtgtcatggtccaatgcaaggataaagataatgtagataaatgttgaatatttttattaatttcatagccatgctaaagtcatttcgctttcttggctacagaaccaattaaggtgcttccctgagctgtggtgatatatagtcggcaggtcaagaggacataataaatttatgcaaaatgtgcaaacattccaatttaataactaacaatgtgtaatccatccatcactttctggtcaaccacttttctccccctcaattcctcataaaataataattttatagtaaaccaaattaatacatgggtttcttatatatatatatatatatatatatatatatatatatatattaatcataagaagtttatcgagtaaaacaaaacaaaattttatattttttttgttattatattactaaatatagagtaatcaccaacctttgtgtatgactaatttttatttaaaaatctgatttataattttttatgattttttttttcaatcatcttataccaaggacttattaattgtataaaattttatatttgataggtaattataagtttgaatcctcgcttatctttttgactgtgctaaatataattttttataaatgtttttttaacccagaaacctttctttatcttgaacctaacatattttttcccctaaatttttatgcaccaaaaactccttaattttttaacaaatttattttcgtccacttaatttttagtcgcccacttaatctcgagttgtccgttaaacatattatataagtgaaaatttacacgcgcaaagaaggtacaaaaaggacaaaagtaaagcccactatgataacttcagattaattgtacaagtataaaacttgggagattgcaatcaaactaattaaaaattgattgatgataacatattcactaaggttcatttcatactgttagtaatttctgttgccacgaaaagaatagttgatagaaagtgcttaatttgtgtgcttggtaaaggaagtttttggatcagaaccagcatagtttaaaataaatgagtagtttaaaatataagcgaagcttcttacaattatgtaatttaaatcacagtaatttttatatgtttgcatatatttatttatagtctttattgtcaattttttaattaataattataacttgttattttattaattaaatcttttgtgtagaagaatcaaatttaaccccctgtttaagcaatgatactaagaacataaattcctatcctcccaattatgactcatgcgttatcaaaatttataaacgacacctccaattttattttattttgtatacatgatatactgttaattactctatctgtaattaaacggaaggctgaaaatttaacactaaaaccctttattgagagtaagagctctaagggtgagtctattggtggttactctaatggaaaaagtaactcaaatagtaattacttattagagataatcagagaacaacttatcatgaatatctaagtttctcttaggattttaaatgcatattttttttagcaaatttaggatgatgtgtgcatatcatgaaatagaattttaaaaatatcccgaaatagatttttttaaaaaaaaaaaattcagatccctttaaatttcatttaagattatctctcttaataattattttgtggattcaaatttgaataacttttcattcatgtggataaaagaaaacaagtattatttatgacatcattttcgaattgtcattatttttctttgttgtgacttcttattatttgtactcttaaaatttttgaatttgtaatgttgtctataatattttagtgcaatcactcctttctctctaaatgattacaatgttcattagctggtttgattcttatccaataacaactctttttgtttacttttataattatcaatgactaagaaatatattcatccattatatatcttgttttagaatttatatgattatcctttgtttttcatcaatatatattataatattcaattatgtttgactaagaaatacattcattcattctaaattttgttttaaaatttgtatgatcgccctttaaaggtggaacttcatacttctttatgaaatcaactagtatttgagattgtagattgaatcaattcccaccactactacttaatgaaaccccaccaaagaagatgttatgggtagttgttgtgattaaaaattcaatccacattggtttgacattccaaatggatttcctatttggcaaatatctgggtgaaaagaattatggaatggaaacataggaaaattcctatggccgagttaaaagaatttgaagaaattggaaggttttttataaattgaaggtttagaattttgcatctaattttttaaaaaaaaagattatattgattgagatgcaatccttaggaaaataaagggaatatataaagttgagaatttgagaaaataaatagatacaagaagatgaaaaatgtttgacgtaaaattgtatataaaatgttatgaattaaggtatttaaaaatgagtttaattttcatacatccaatcaattttttttttctaataagaaattgacatgtatggtattttattttcttttacaataatacattaaaagtaatccttataataattttattggcttttacattattaagtaataatttttttataaggataacttttaaagtattattgtaaaattcattaaaatacatgcatgtcaattttttattcgaaataattgatcggatgcaaaaactttttctttatttttacaggtgctaatttgaccgtttgcaactttgcatctcctggtacttccggacccttttcctatgtttacattttttactgttatttttataagtatttcctattatttttgtattctatttcctatacatttttctatttcttaccatacagtatagaatagaaacaaaataggataaatttacgtataatttattatgtgctagcttttacttcggtaactcacttcgttttttttcccactgaaatggtaaatcacacaaaaaatgtcacattaataatcgacattactagttcttaaaaaaatatattagttatttgatttaaaattcgaattttaattaaaaataactcaaaaaaaaaaatacaaaaggtgctatcatcccaaagttttgtccaaacaaagattgatggtggcataaaagtcgaaagagacgcacaaagttaaatagaaactggtgcttatccgagcaaccagtgttatgacgtcatagcaatccttaattgcctccccaatgtgataaacttgccactaaaagcacttattaagttgttttccgtgagcaatttatgttatacttgttcttaaagcagtaaaaatgacgtagcattataattaagcaagtatgaaaactatataagcttaaaagaaagtatatatgaaaattatataaaatgatttttatcaactcgttggatatttgcttttattggagtttttctaaagtagaaaagggatgcatgcatgcatctgattctctttatgtcagttgtaagtttgcagttcaaaatagataacaacttaagtttctgagtacgttttctaggtactaccactttgatcatggtctaaccctgacttttacactttggcaagccaagacctatactataatattaactaaaacgcaattagactctggtggttagataaactgaattgaatttctccgatatgttaaaatcgacgtatccacttcaacttttagaaaacttaaatgagggcatttctataaaagttaaatatataaattgattttaacttatgaaaaaaaactcaatttattttattttttattttcctttcctttaattagttacggaggagtttatatacccaaaagagccttaatttttaattattttatttccaaaagaattagatacttcaaatgcaatagttgaggaatgtttagttggtagtgtacagtggtcctgctaggcaaatgagggtcaatctatgatgaaggaattgaaggtcttcggttcacgaacactctaatgccaaattaagtcaatggaataagctagataaggaatgaaagtgagggtgtgagagacagagagggaagagtgatggattgatattactacaaacaaatggaaggttggttggtggtggtgtcaactttagctggactacgttttgagtataatcatgtatttatccttatatatggttgtgatgagttgacttgttgtatattgatcgtggatcatgcaaatccacatttggttgggaaaaaataattattaaaaaataagaatagcttgattaaatgtcctccacgcaagtaatcattatttagttttaacacaatacatttatcttgtatcttgaaataaatagtttttgtagtcaaagtcacatgattcatgaaataggtcaatcccttaaataaattttaatacctccagagaatagtcctttactttcggccaatcgtggaaccttttacatgggtgaaatactagataacttcaagtcgttatatacttgattgttttgctttataataatccaattgcatattttgctcccaaattgcttcatgatcaagtttaatcaggtgtgcatttttatctaggcattggtttttccacaagttgataaggcttctttagtggaggaatagtactcattgacaaactcccacatgggtctgcatcacattttggcaccggtatattgactcttgatgtgtggggaacccaaaaattttgcattattctgatgaattgctcttctagtaaacaagccatgtctacaaagatcaatcatggacggttaagattctctgctgaagtttctaatcctatgactgataccaccctacacaatttttataagatctgcagctaaaccttttgtcaaaagcttcatgtgcatgtggtggtggtacggacccttctaattatagccaaatgaactgtaaagtgtaaaagctataccttaaaattccttcttgtgttaaggtaaaaacagttgtgtaactgatgcaccattaaaactatgcaaaagtaaacccgaagtttgatagtaaaaagactcctcaagagactttttgtacaattaggcagcttgtcggcaagttgggcataatagaccccacctttgattaatgggaagagaaatgctgcttcatatatagttgccctctttaaaactacaatgcaccaacaaacctttttgtggtaaatttttgggtgaatgatatctcactcagagtcaaagactaatttcttgataattaatatttatttaaagaattaatctctctcaataaatattttttcatatacaaatttgaaaattaaacctctcgtcacatgttgaatattttttcatatacaaatttggaaattaagcctctcgccacatggtgaagaaacaaaattatctgtcaatcatatcatatcataccagatgattatatcttttgtgaaaaacacaagcactaggtaataccaccaccaaaataccattattaaaaggctttgtacaaattgttggcccttccaacaaccctttgtttttctctgtagagttcagagtctccaatattctgtcttactccaactagctgagaaccatatatatataataattaatctaagttataggtagcaaaagtaaaccaaagatagttgaagatgtggcgtcttctagctgcagtggcaagaaaccttcagaacacaagaaagagttccaaggtggcagatgagagcatgtttgaagcaggaaacggtgtagagctatttggacatgagaggggcagaagacaatatggttgggggcttgtgtgtagcattcttcaagccccgatatcaatactctcatgtgtttctcagcctcaggttaataatggctctgatggcgtttgggtaactggggaattctcacaagtgtctgaaatgaaccatctcatggtaagtgatagcatgaggtatgcaattttgatgtaggaaatattgtgaatatcaattgttgctcttggtttctaacttctaaagacaacaccatcacataactctctctcttgtcctcatttttcttttctcttctctgtttacagtttggatcatatatatgtaatacactaggtgattgaatagatcagccaaagttatgacctactttttggtgtgtatttatcccccccaatttttccattgttaataaacaaacaggtgtatatatgtatggaattgagatatagagtgtgtttgatttgtatttggcaagcctcaaacgtccgttcaacaattgctacttcttatttttgtgtgcattggaaagtgagaatttccgtttacaaggatttgaacgggttcataatttcatataaaaaattgatgaaccccccctcccctttctccatttatatttatcactctctaatttaaatacatatatgcttaaaataagaacaagaaaatcattttgtcagcataaaacatatgactaggttcatgtcctacaaagaaagagaaaatatttgaaagagtttggctttaagcagttgatgcctttttacttttggtcataataaatgttgatataaaaagcacacaagccactttgtattgcgatggctgatttctgttttactcatagtttttttttttttttagaaaattttactcacatatatagttaatttggtcacaattctttgttgttaaagtaaagcttctaagatctaacttgcagtatacacgttcgtattataaggtttgtataccatgaagataattatgaaaagtgggattatatgtgttgtcttgtataatgatgtcaggttggggagaattatcatgggatgccttggaggaaaagaatataaaaattactcttgttttcattttaattaagtagtgtcactattttttttttttgggtgagattaagtagactcactatgttaattacgaataagtagaggtaaaagatcctctgtcatttaggatttatagctttaatctgactctaattggttttggcatcgtctattgttccaaacgtattttccctaattaaaagagtctgcgcaattttacctgcaatttttttatgagtattagtaacactctttagcacttttttttttttttatgtattctctatatttagctaaaatttattttagaagtataaaattatgagtgagattcattaaataagaaatgagtctcatacaatattgtgatttctaacaaaattaaactaacaataaagaatgtgttagagtgcatgatgctagctagcctttttctttctttgattttaaccactatcacgaaaaaattatttgatgatcctgaaatatcaaatatttagagttttaatcaatttttatataacatgcatttagatttttttaatttacaaagaaatagtaacatttgattattgatatgttatgtgatgattaattaagaaccaaatagtttaaaactatcaaataatttctccttccactcccaaaccagaaagaatcatataatcaggtgatttcacacagcatttgaggaataataatgcttggattactaaatgcatcctaatcttgtgagttcatcaaacaaatcaagataataataaaaaatgctaagatcggagtaataattcatttaggggagaaattaaatataaatataattgcagtaataaaataaaatacataaaatttatcgttttgcttaaggtggtcctaatcagggctgcgcaggagggcaccaacatatatagaatataattcttggaaagcaattggtgatccatcatgagaaccctaatagttgaaattcatttaatataagggtacccacagaatgccatattcaaaaaattgaaattattgatgcgaatgtaaaagtgattttgtacgtcatttgctgttcatgaataaattaaagaaaggattcaacagtataacacgtgaaaattattaagggaatatataaatatatatatagttttcactatcagcttagatttttggatattacctcttgatttagtttctcttaatttcccattcttttcaaaagattttcgatacagcttattgattacacttctccaaaagtcgtctctctaagggaactttgatcttaaggcttgctaagtgaaataaattaatcttaattatataactacacacaaataattttttttacagcaataactatacacaaatattgaatattactttattgaatctaatttttatcaccgattttaattatacgatcaaatctaaattcttcatgtcctatcgtctttctcttaatgtgttatatatgtgcggcattttggtatgtgagaggcattatcattacaaactcgtgacctactcatttctccactattgcaactacctaagctctaactctctttgcagctttattttcgatagtgctaaggttgcactttttactgaattttcaataaaaaaaaaataattcgtagtgtacaattgtatacaattgtccacatgcaagtcactaattcatgcaagacaatggaatcaatatatattgatcagcaattacaaaaaaaaaaaaaaattggtttagttaggtggctaggattcaagtttcttaaccatgtaattttaggttcaattttgaattttgtttacttatgaaacaaaatattttgagaagtatattcttatcattatcattaaaatctatttatattttacaaaataagtattttaaggattaagtaacccaatatatactactaaggaaatcattttgttaacccaggttatgtttaacaagattacctaaaaaattaccttgaaagttggaaaattagttgtaagttgatatttagaagctaaaaaattagctaatttattaaattgaaaatgttcaataaaaataaacgttaaagtagttgaaaaatataaaataatagaaaaataattaaattataatttatttaaaaatagtaactagaaaattaaaaaatatattgagaataaaaatgaaaaaaatataaaaaaactacaaactaaagttttaaaaaacgttacttttaaagcaatgtttaaaaagtcactaaaaattattaagaagttattaaaaaaagtaaaacaaatttttcagttaataaaaaaaattaaaagttaattgaaatatcatagaaaacacaactctaagcattaagggattgattttaagtacaaattgttcattaaactacaaatagttgttattattatataagattattctaaatttctaatgctagccaagccacatttgcaaaggtttcccacgtttttcaacagttattatcaaaagcaccatcatttgtagacatacatatctatattatataggcatattgttgatctccactttcttaatgagtagtgatgactactatgaactgatgaaagacgtcttttgattttacatattcaccattaatagtagaagctttgctggacttggttatgtggtcttaccctttacattgataagttattcaaattaaaatttgtccatgtggtcggttttatcagttatctaatattaattggctaatgaaaagaaaaagaactattacccacaataatttgggccacttatatttcccatcaatagttgctaattgtttcagcaataatgggggataggagaaaaaggaagataaaaggaggcaataaagaaagacacgaataatatgattggtaatttgtttgtcaatattaagtgggaaacaatgaaaaaatagtcaattattatgccttttatctttgtaacattttgtcttaatctgaatttcacaccaaagtacattttaaaattatttaaaataaatagtcatttttatccttaaatatgtagagtttaataaattcatttatgaaagataaaaatttaaattttagtccctaaaagtaaaaaaagtacgacaaatcaatctattaatttccgtccattaccattaatgaaagagtctatgtgacacattcaggaattaatttgtcgacgctctatacattcaaggacgaaaataattatttatccaaaatataatttaatctttattttcttcccttttttaatcgttgcaaacataatattataataaatacttaaaaaaaatagaaaaacaaatgagacatatttttatcaaaatatgatactcaaacaaaaatgcatagttattaagttaattcttaaaaaaaagacccaaacttgattttgtcacaaatagaaattttataatagacaaattatgtttattaatcaatattatggttattaaaaatataattttgtcacttttctcattaggactaaaatttagattttcatattctgaagatcaatttatttgtgttttataaattcagggataaaaatgactatttatccaatgatttatctatgttgtagtagtcttttttaataatattgatcaattataaatcattttatgattttaagtcactaaaaacagttaacgattttataaattcacataaatatttaaggtagtttttaatataaaaatttttagacaaaaaaaacatttttttttttactttttaaggtgaaaaagaaaagttgtggcagttttaatttattagaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaggaaagaaagtgaaaaaagaaagaaaaaaatagaagattaatgagatgattttttaaattatttaaaatgagaaaaggatagttaattttttctcttctttaattatgtaaaaagaaaatagaataaatataaatactatctataaatgaaaagaaatatataaaaaagaagacaatttaatctttttgtaaaaaaataacactcatttctttacttttccttccacttttagacaaattaaaaataatgtgaatctagttagccacttgcacttcctttatctcacgttatactttgtacttcattcgtgattaattataagatttttttaattaatttatgctttttaagaacaataattaattttattaatcatattaaatctattaattaattatactatcattttaaaattatcagtttcttatctttctattaatttaattttttattattaatgtttgaagaaaataattaagtaaatatatgttgtagaaaaaaaatcaatgcatctgaaaattacaaatattttatataaaaagagataaataaatttctaaaagaattttataattaaagattgattacttcggaattgatagaaagatatagaaaattatgttttccttgttttgtatttcattccttcattcatcaacctagcaattgtgagaaataaatataaatataaatgcaaaaatgaaattattgatgtgctcagtcatgagcacaggtggtaataactgttacctgtacaattactgttatccgtaataattgggttctgaattttccttggtttaatttggtattatctattccgttgattgacaattgacattagtaaaccaacatttatagaatgcgttgaagtctttttttttttttttttttgttatattgtttcgaaccctatttctgtactacgtgggatacatataattacaagtttgaatgaccgaaaaactagagaaaatgaatagttctgtcaaagcacaaaagaatacattatggtaaataataattaaacaccctgcatacgtggacagcgtctgcaacactaattttcagaaatacacgattcatttgtacgttaacacattgttttaccatcgatatatactctcaaatcttgttcgaatttagtacttttagaattattatgaatgagaaaattttatctttaaatatttcatactattatatatacatgaacctttataacttaatattaaacttttattcgagtgaaaaaaatgttgaataaatttctttaaaataatacaaaaattaaagcaatctatgttggttcttcatcatccatttgaaactggttttcacaatcaaaccatctagttcagttctttgttagaagtaattaatggttcatcattcatgtatagcatgcatgctaggatccgcccctagtatcccactatcacaagaaaattgaagttgcaatctaacatttcctactagctactaccaacttgctttgtggcttaatcgaaacaatggaaagactttatgaactctggctaccatagtacgatgaattcttgtagtagcaaatcaatgactgggatggtgctaacaataggcatcaacaagcgaacgattttgtctcttcttgatcatgcaccgagttttgtattgtcttcatcaaactttcttaaagataaattctttttcgtgaggtaattgtatgatttttcaaggtaaaggagtcccggatcaattaacaacaaagttttaataaaagtaatccccgaaccatattcttctccaatctgagttttgctcacatctaaaaaacctcctacccatttatttatgttaccatcttctgttataagaactagaataaattactgtcagatgcaacaaaaaataaaggttgcatagggtatatatattacatttccgtgattctctattaatctcatgcaactatccagctaaactttaaatcaatctatttggagtattctaaaaaatttgttgcatagattagtattctattttatgttttctagagtttgagagtaatgaacctgtgattctgattcctgtgtgaggttattcctattttctgtaatgagatgcccagttgcctatcagcttcttcatattcatatcacatccaaacatttcaattgacttaattaatatctcaaatctatgatgcacggatattccaaataaggaattgttgccatgtaatgttagataagatgcaactctttaaaccctaacggaaaagttcaaacttaaatttgttgcactgcccatgctccattgtgagtttcattctctctacttcaacacttctttcaattaatttgcaacccttaaaaaaacaattaatttaattaatcatattaaatttatcaattatttatattatcattccaaaattatcattttcttatctctctatctacttaattgttttttttaatatctgaatagaaaataattaaacaagaacatgtaagaaaaaataattaatatatttaaaaattaaaaaagaatcttataaaaaaaaaaaacaattttttgaaaatagttttataattagagacacaggagtactcttttacttaattacagcttgagttcttaggacctctaaggtaacggactaatggctctcttagctgcatcagttctttatttgtcttcttcctcccttctttacttctttcataactttttcctctcttctgtgtttctttctacaagaccagttctccatttcaactttcaattagattcagccagcagtgacaagagaatgcacctggccacgaagtactactgccatgcaaaatccaaccaatacctcaaatgttgcatacaatttttcaaatacagttatgaatggagggattactagggccagaaaacatctgattcgagggaaaagaataccattgtatgtatatcatgcctcaaaaacctgagcgatcctaattattaatcggttgaaactagaaagtagaaagtatgtaaataatgataaaaaaaataaaaataaaaaaaagccggggctaaacaaatttggtatcagattttgaggaatttaacataaatcatataacctgacactaaaaatgacagaagagacacaaaactgataatgtcaagttccaaacactgcccatcaaagaaatcaaagcaaaaggcaccaattgataattttgcatgccacaataataataaataaataaataaataaaaattttgccaaaaagataataaaccacaacagattaagcttacaagaaaggatgtaaggaagctcatagggaaaattactaggtagatgtatgaagcaaatcccttttaactctgataactacaatatgtttgttgcaatgactactgtccatggccaatatggtactggcattaaacccccaagccatcatgaagtaagcagtccatttctcaatgaatttgagcacattctcaacttgatgagagaatacagcaagaagtacataaaacatatgatattagatcatggcagatgacaagaaagtaagaaagtgccacatgaaacatataactgagagcaacgatctcatatcagctcttattctgcaatcatattcaaatctctttgaatagaaaatcacgtagataaaccaaaatcaatgattcaaaatcacgtagataaattagtgacactaacaactactttatcaagattcaaaatcaatcaaaattgagtactgattcatgaataatctgatattattttttattgtgtgatgacaatagcacaaaaagaggataagaagcaaagcttctaacattaacgattcagtatggagaataaaataatgtataaaagctatgccaaatatcatagcttatgtcaatctagtgtgatgaataatacaaggtggaaacatatttgatttcccaatgcttccaccaaaagaagaaaagggggaggggaatagagataaaaggatttctaacaattaaacagataaactaaaaccaatgcatccaatgtagcccatttttccaataaatgaatagaaatcatattatccttaccaaaattggatgaatcattctacatctttaacacattaattggaccttgaccaattctccttaaatgaatattctattgattttcatcataaaatccttttcggaacatttcttcaagccaccgcctagcctcatgtttcctcccatgaaatgagaaaccacgtaccatgatatcatatgtccaacaattaggttgataacccctttgacacatccgagcaaacaacaaacgagctttgtccatatcactgttggctacttgtttcagcaacaaattgtatgtgaaaatattaggtggaaagcacttctctactaatctttccaggtccgcaatataatggctcactctgagacgaccagaaaatgcaccaatcatccagcaaagtgttgaattaccagaaaataccccctcttccacacctcttaaataaatgcatgtatcgtagagttgcggtgaaatcaaagaatgataaagaagtacattgccaacaaaagaacttagtggacgtcccattttctgagatacattaatgatatgtattgcttcactatacttttgcaatgagcaaagcttttgcacaagtagctcatagcattcaaggcttggattcaatccaactcttaacatgcagaaaaagtactcacgtgaaatgtctatcttattgaacttgcagagaccagtaatcaaggcaacatataacttcttagttgccaaaccctggtgccgtacaccattaaaaaaattcagagcatcagaaattctcccattgaataaataaccatgcaacataagaataagagaagacaaattgggcttaataccattcctttgcatcaactcaaatacttccctagccaactcaggcttcatagcatgtccagctccgtcaaggaaaaagttgtaagtctgacaagaatgttgacaacgagtcagcatctccagtagattgaaaaagcgccctcttgaattatccatttcaagcaagcggcaaataacatctctacagaatggacgaatcagcttatgacccttccctttcatttcaacaagaagccgagcagcaatatctcccctaccagacttaacaaaacccttaatcatcttaacatacgatgtcctggcagcaacactcttaagttccccatgtaccaaataaccatcttccactctcccagcccggcacagagccaatatgtacttgtcatacattgacgtaggaagcacaatattatgccccacggcaagatacaacaactccttcatctcatcaatcttgtgctccctgcacaaagcactcgcaagcgtgcaaaatgtccgcccatcaggaaaataactccgctcagccgagcttctgagcaccttgaatgcttcctcagcgcccccatcccagcacaaagtaagtatcaaatacttgcaagccaagtgactgagagacaacccaaagtcagacctcgaatggtacaactccaacgcgacatctgccatccccactttgcaaaagaagcataagacagcattcatggtaaccacatcaggaggaatgcaactctcattcatatccaccaataaatcatacacctcgtgaagccgattctcctgcaaaagtctacaaatcaaaacattatacctaacagtggcaggaaaatacccttcagagtccttcttctgagagaaaaactgcaatgcctcatccaccctcccaccccgaacaagaccctttatccaaaccccataagcatgatccaatggaaccaacccagagctcccaaattgcttaaccaactcaaccgcacgctcaaacctataactctcacacaatgcatcaattaaaaaactcacttcaggcccttttaactcctctccacgacacatcaaaccattgagaaaaccctcagcctcctccaaccttctctccttgcacaaatgcttaacaacaatgacatttgtcatgtgattctcgtagcccctggcgcgaatttgcctcacgatgatgtcaaacgcgttgagatagtttttctcgacgagggcgtccaacaggacgtggtaggcgaaggaatcaaggtcttggccgtggaagcgcattcggccgaacgcgtgaagggcgttttggggttttccggcgatggcgtagccgacaacgaggatgtcgtggaagcggacgcggtggtggaagatgcggcggcggaaggagtcgaggaagtcgaggacgaggggcttgaggtcggcgcgggcgaggattttgaagatggcgacgaaggtggcgcgggtgtggaagaagtggggctggcggccggcccagtcgaagaacttgaggcaggggaggatgtcgcggcgggcggcgccgtggcagaggacgcggaggaccaggcgctccgataaggggaggcggagggcggagagcgcggcggataaatactcgtcgtcgggggaggagatgatctggtggatgcagttcaggaggggatcgaaggggagctgctgctgccgcgccgccgcgaaccacgtcttgaaggaggacgcaacgtcgttttgggagataaaaaaggaagttgaggctgaggatgatgttgattgggagggtgatgatgatgctagagaagtgtatgcagcacggtcaaagcacgggtcgagaatggaggagatgaaggatttggatctgagacggtgtttagttacatgtttgagtgggagcatcatggatcaatggaactggaatgggaatgttcttcttcttcttgtggtggttctctcggtctcagggttccattgcattctaagtgtttgtgtttatgtctctgtgtgtatccatacctgcggcttctcactacttcttacatcgggtgttaagggtttatggggggtttcatcctccgtaaatgtctaaatgaacttgacctgttttgatcgactcactgcaccacccccatttgtggtttgaattaggtttagaccatatcaatactactagaatagtagagtcaggtcgtgcagctcagatttactgactggatcaaaaagtaaattcatttgtcaggggaacttcaaagttcaaactcagtttgaaataaaaacaatttgctatcatttttttttaaaaagtacgtttgatgttaaaatttaatttgaaaactcaattttagaaaaataacaattgaaatatttttgtaaattcagtttataaacttaaatttaagtttgcaaattacaatccaaatatacatttggttgaaggagtgtttgtttctaatttcatattattttcacataatcacatttcgatgaatattatgattcgaaatgttatttttggatatatttaaaaatatttgtgattatattttaatatttttagaaatatcttttaaaattcaaaaaataaataataaaggaagtttatggtatttttgaaaataacttctcttatcctcgtgaaatatcttattctcgtattgttcatgggaacagagtgtaaaagaatatgttaaaaataaaagttatcatatttatgagaattaataatatccataaatatgttttcgaaacttataacaaatatgggtatataatactctcatgttataattttgggaataaaatttttattcttttaatccattaaatatacatactctttaaattttataataagtagaatctaaattggttttaagtaagatcaaattaaatccatttaaaaaaagttgctaattgaaattttttaaagtaaaatatctaattgatttttttttaaaaataccttaattgaacatgtaaataataagaatatcaaatttaactagcaaaataagttagaggaaaaaaaattaaatcattttattatagactatttccttaccccaattaaagtaaaatttatgaatatgtcattgtgcatgacacaaaataaatgtttattttattcaactataatttataataaaaaatatttttaaatataaaaaatatattataattnnnnnnnnnnnnnnnnnnnnnnnnnaaatttgtaataaatatttttaaacatataaattatattttaaatttatgataaataatttttattgtgatagatggttatttttaagataatttctttttaaaaattttaaattcaagttaatattaaagatgttaaaatgatagattgaaagatattagaagttaagttaacctatttagataatattaaaaattataagatgatatatacatcttagcaacatatttgaattttgaaaataatatatatttgaaattattttttgatatttagttacgaattgttaaatcaaatcattaaataatcataagaggatacgtcaaatgtaagctgggagagggaagttcacaacttaatgagcaagcaagtacacttaaatgtttataaaggtgttcgtatattatatcaaattatcaattgcagtaaaataaatattatatgtattaaaatactacttttttcacacacaaaaaagcagtttaaatactactttaaaagtcaacaaaagttgatttaaaaaacaaattcatatcctatgaattagaatctgtagtggatgtgaaaagattttgctggtgaataatttgttatatgatattaaaaaatattactttaaaattaaataaaaaacttgaaaatttaaattttttgtttcttttacatccaatcatcttcattatccgattcgcttatctagtaacaaagattatcaaacctgcttattactaatctttccactcagtggtattatcaatttaaatgtgataaactcttttgccattataaaatcaactcaatttaccaaaaagaaactgattctagtcaaagacttcatatattcttcttaattagccagggaattttctgtgcagttctccacactatacaatctgaaagtcagaactcaacgtatagacatcttttcagctattgccgtcagcatcacctttctgtttctcataggtaaggtaatcaatgtttttaagatttgagagttttgactctaaataatagttgaacgagttttagcataagggggagagaggacttaaaaaagagttccacacagcaaaactcttaaatgtagggtgttttttttagttcataatactcccttctcttttatataaaaaaaaactcaaggtgtttgctcttaaaaataaataaaatttgattatttttattttcatttagcatgctttggaatttctattaatttttatttttatttaaaataagtagtagtcatgatgaactcgttcccacacgagaaaagtaatggtgacgatgatcaagatgatcagtcaacagaagacgattcttttctaaaaaaaggaccatggacagcggaagaggatgcaatattggcagcatacgtgacaagcaatggagtgggaaattggaatatagtgcgaaagaatactggactagctcgttgtgggaaaagctgccgattaaggtggacaaatcatctaagaccagacttgaaaaaaggagcatttactgaagaagaacaacgtaaagttattgaacttcatgctttactaggaaataaatgggccagaatggcacaagaggtttgttcttttttgttatagatgttttgtctcatccatgataaaagaagtaaatttcataaacaaggactaaacgtgaagttatttgagtccttcgagttgaaccagcagtggtcatgcgtgttattcagttgtatgtggttaatcatctaggtagactcaggtcagagatacatccgtaacatagatcattgtcatcataatctattctttattatttcctagaaataacattataatcaatctaattcctttcttaaagttatgtataaggagaataatttccatttttgattcattaagggatagtatttttatattatacatattgatgtgtttcatgtagttatattgaattttgataatatattgacggtgaatacgtgaaacaaattaaagtatcggtgcttcgtaaatgtttacttgtgccttcatttgcatgtgttagatgcctggtcgcacagacaacgaaataaagaacttttggaacacaagacaaaagaaaaggaaacgtgctggcttgccactctacccaaaagacatagaacaagtgttgaatgttgacagcccacagagtagttctcaaaatgcttccacccaacatgctaatgactcacaagtaggcacatcatctcataatgtaccagaattgatattcgacaattacaagcttgtcaatcgaaaacaccccgtgtgtgtaccacccatttcaatgatacctgctgaaaacgacagcatctttgaacaacaaggtaattcagataaccaaattatgcatccccccaagcagcaaattatgtatcgtccccagaagcagcttcatgactcagacatgctaccaattgattagtaagtatgagaaattttatgagcttcctatgttgtgtgtttatatttttttatataacaaagtaatgtgtagtataaagtttcagggtgattacatgtcttgtggcacttcctcaatgtcagggccgcttccatttccatcatttgattactcattgagagtgagagaggatcctccgactgagactcatgatcagtactatgaaccacgttctccacgcagcaatggttttttggaatccatattttgcccaccaccaaagattgtggaaggatcagatgattgttccatgcaaggagagtcaagtttaggaaacagagaaaattcagaccagataaaccaagatactttaggtgactctagtccggtagaggattatgacaaggatcgagatgctcttaaggatactttatacagcattatctaccccttttttccacactaatatataattattcttaaattgcagaattttgtaagagctattaataaagctgcggggcttcactctggtggaggcttctctttttcaaggctccatcatgagtgacagaacagctacatattcttctggctcataatataataataataataataacaataataatattattattattattataataatattattattattgtcttattactcttatagtttcattctttattttattcttaggggggtcattgattgttatgaatcatgaccattctttatttttctgagattgtatatatgaccctttttttttaatgtttacagcaactccttatgtgtattcagtgttatatatttatcgagtaactcagtgtaatgcatataagttggttctgggtgactaatctcaaaacttaaaaaacactcacaaattatgtactaaagatgtcttcggttgcaaaaattgatttcatatttttataagatatgagttcgatcaattcttatcagctgaattaatttttgtttgcataaatttaatttactctgtcttctattattctatgtgctttaatctcctaagctactcaattttatatatgttgtttaataataatgatattttatatcttatgtcccctttggcgtttctccactatgcaactggtcttttaattttatgtggtgttgatattttaaataaaattactatagtataccaagtaattaaaattttagtaaaaatactaataatataaaaactattttgaagggggattagtatattttgttcttgtttactatattttgattaattgcaattatattttaactaagctaagataattaagataaattatattattaattttgggaaatattaaatatttaaaatgttactttatgaaagtttagggaatacttcgaaatttcaccatgaagctagcaatcttaattatggtgattaaaaaaacattaacaaactcgataaatagctaaattgactttgataaattgataattaaagatatattttcaatcgaaatatgttatcttgaaaaaataataccatgtaattgctttcaaaatattttccattatcattgtgatcctagtatcctctcttctctctcttcttctcgtttatcaagttatgctctttcatgttgtttccttccttagtagtaggctcatagcttatttctttttccatctttttagtttattttatttttctccgagggaagatgatgatgaattgatgatatcttattggaaaaaatagagaagatgagtaattcacattttgagttatgtgaaaatggtgataaaccacaggctgatgatgatgaagggacacatgagaaactagctaactacagcaacagaccagtgtgaattttgtggcaagaagtttagctctggcaaagcattacggggccacaaaagatttcaccttcaagctcaaaggaaagcattatgagattttatgcttttgtgtattttcttcattattgaattaagcaacaaaaaagtcttatatagagtttacatgagtagaaattttgctaacaaaataacaaacccaacaaacagatcctatattcttgtatagagtttaaattctgctaacaaaataaaaaacccaactaacaaattctatatctataacataaagatattattgttataacagataacatatcctataacaataacaaccctaactaacgtaaagatatgattgttataataaatccattctataacagaatctatccgtattagaataataactctaatggcaatggcatcattcccatccaataagtccttctacggacatataagatcccattctgataggaattggaagggcattcaccctgctctatcttctctccccctgatcataagcatagttctcactctaactcatctattgaagagagcaaaggttgtttcaatgcagatgaagagacagctactgatctatcaaaacatttgcaaatgcaaccaagatggcatattaccaataacaaagatggggtacgcgttgatagtgaagaagatcgtgtagctgctcaacaagaataatactttattgatactgaagaagtagaagaattctgctatgctgttacctttttgttcaagagtgatgtgttgattcatagggtgtttaggcataggtttcatgtacaccaaagtgtttaaatgcatggatttcaagaacactagtcactagatagtagatacgatttaataattagattgatgatgttggagaatgtagattttgctaaaatccagtattagttatcattttgtgatataaaaaccaataatatttagcactattattactctatgaattaagacagatagtgatcaacattagctaatcttaccatcatattgtggatgtgaccaaagaggaataagatagattgacacaaaaacggatgatgtgtaaataatatacatgggtatgactttgaaactagtttctcacatgaaaattactcaaagtaaaaaaactgttcacactgtattcttcagcccctccaagataaaagtttctagctccaccaaaagatgagcatatttccccacctttctgatacgccttggtgcataagcttttctgttttgtttccattttgcttccaccacaagtaatgtcaccatttttttcttctaacttctgtttcggtatcgggtccctctccttcccatggttcatgctttctttttgttcttcatcctgccagttttggcttctttgtgttcgactttcgatgtgctttatactattgtctttttcttctatgctcggctgatcaggagttgagaacccttcttcaacatggaggctctttagggtttgtccttgttcctggttcatctgattatctcttccttgacctatcattttagatgctgcggtcaggaggagaaacatgcaataaaacaaagcatatgctaatgctagcccacatgtgaattgcaaaaatgaaaacaattgaaaatattggagcctataaagatcacatggttatattatgactagatgttaaatctaaaagtattctagtacttactgttgggggaagtctcagtgctgaagaggtaaagatcatgttcagttgaagtgtctggtagtggtatactatctgtgtatgtttcatgggtgctaccgggtcgcgtttcttggtggaggtgtagtggttctcttaaacgtacaattttattgaaacgccttactcttaatataccacaagaaagcttttggaggaaatactcctcatcattcttcattttcctgtgaccacccagatgcatcttacattaatatgaggttgtagttagataattcactaaaaatgggttaggattttacactggaaatagttacattgtttgtcatcttatttcattgtttaagcaaaagaaaggtatatttgtagttacctgcatcctaaaataatttctagctcttaaatttgagaatgctgcactacatgtatgtatttatacagatttggtttcgaccagtgtataattttcaaattttttttgtaactacgttatttaataaactagtacaaatacccataactaaatgaaaacatcccaattcaacttcacctacgttgactaattcataagttatctatcattttgtctttcttctttttgttcaatgtatatttcaatttaagcagttgtattgcaaggcctaacttgctattgcttgagtgagtagcctgaatgattatctaggggtacaactgagatttagattgatatataatagattttgactaaaacaaattatatgtcagaattatgttgtgatcttgctgtgagttagaaacagaatacttgaaattgtaaaaggtgattgatttataagtaatgcccaaatctaagagctcttttagtaggaaggtatgacttgcttagacattatgccccatagaccttagttaatggattttattagattatctgttttattttaacttgaatagtcttcaaatgaagggtttcaaaagaattatatcattcttgcatgcctagtaagtgtagaatttgacatgtttttgttagtccatccatgagactaagataattcagataatcaatttaatttcatttgacctgtccagtataagccaagttgcctttagcatcatggctgatttcaatgcaaccgtcttcagtgatgatcctgcagccgtttctatcttaaatctaacctgagaatatgatgtgaaaagtttcataagatggaaaaacagcaggtctagttctcttaaaatgatttcttatcttgagcaaaacatgtgtggtagaactatagaggaataaataaaacaacagcttaaatcattgaatgatttcatcaattatttctgtttataaatgttaattgtacttttgagaaacaatgttacaaggagtactaattgtactttaaattttggagaagcactgttccaaattattgtttctattcagtttaaatcattgaatgttaattgtactttggagaagcagatgtgtagatcattcaagacctatgtttagtgtatgtatgtttgatatactcttactttagaagattgtatttttgatctgcaataatttggagaaatacttgtcggttcacagcctgcaactacaagttgtagaagagtgttgtctactattttctattagttcttttaagtcataaccataatactgtcaacaatggaaatgattttgttttcgtgctaggagtggatggattctttataatttggtaaatcttaaatatataaaactcattttgcctggtaggcaacacaagtagattttgtcactggtttttatcaaaacgtaaagttgtttacctagatgagtaatgagttgtattagttgcaataatgaaaataatagaaatagggagatctgtttttgttcttctcctactcttattttgtatattgtttcactttgtcatcatctggttacactttatacaagttcacaaacaaaacaatgacttacgtttttgtgaataatgtatactcattcctgtgggaaacttttgacaacaatatccacattttggaatcttgaatactttgatttaacagttggaagttagaatgtactaaaacaaatatcttttggatcactgcttactcaatacttcgtagaaacaactactttgtaccaaattgctgagtatgcttttgatattataaccccctccaaccacatagaaaatatcaccaatatatttggcacacctttttcgtatttttacatgattaagttgcattgagattttggagtagaaatagtatattcaccatatatgtaatagagtataattgttggaccatttcctctttaattaagagttggtagaattagtgggttggtgtagtaggtgtaatttaagagttggtagtgggttggtgtagtaggtgtaattgatgtagtaggtgagcatccttggttggtgtggtaggtaagccatcttgaggctataaattggcaacattgccaatggtttcatcatcccaaaaattgaagcattcttcaaagcattgaagaagagttgtgtgggtgagagaattcctctttgaagagagtgagagaattcctctttgaagagagtaagagtgttcctctttgtagagaaagagagagttccaccatattggtgagagataaatcctcccagtgagagataaaatttgtaagccatccttagtgggtgagatatatattttgagtgtatacctctagtcttactagagagatcatctttgtaatcctactttcatagtggatgtttttctggactagtgtcccgtggttttactcttcacattgaggaggttttccacgttaaaattgttttgtgttctctgggtgatatttttctgcttctatattttcccatctcctcacagatttacttcgcttccgcaaatagatagggttaccgacccaacagtggtatcagagctcgtggttcgacgggttctgaaggagacgagatggagaccacgggcataactcatgacggagatatgttcaaactcaccgcagagaactactcatactggaaacccatgatgaaggatcatctttattgcaaagatctatatgaacccattctgtctgcaaacaagccagaagggaagagtgataaagagtgggaagtcctcaaccggaaggcggtcggtacgatccgcaagtacattgacaagagcttattcgagcacgtgtcgacttacacaaaagcccacgagctctggacgaagctggaatctttgattcagaaaaagacaccgcgcaacaaagaagctttggtgcgtagacttgtgaagttgaattacaaggacggacaaagcatgatcgagcacttgagcacatacaaagggctcgtgaaccagttaacaaaagctgacatgaagattgatgacgagttgcaagcgcttttgctactcagctcattgcctgagagctgggacactttggtagtgacgctcaacaactcggtccctgaaggaaaattgtccatggacatagtagcagacagcctgttgaatgaagaggctagaagaaaagaacgtgggatgactagccaatacgaggctaatgtcgtcgagaaccgtgggagatcggaaaattgaggacggagtaaaagccgaagtcgagataagtctcgaggacggtcaaaaccgagatccgatctgacatgctattattgtgggaagccaggtcataggaggttcgaatgtcggacgctcaaaaaggaccagaagaatggcatcgtgaagccagaccagatagatccaaagaagaaggaagagcagagcatcactgccgtagcaaccaaatccgaggccgatatcttcttaatcggtgaggataattatttgaatgttgcatatgatgactgtacttggattgttgattctggtgcttccttccatgtcaccccacatgagggattcttctctacttatagaaaaggagattttggagttgtaaaaatgggaaatcaggtgaccagcaagattgttggtatcggtgatgtgaccctgaccacggatgttgggtgtcgacttgtgttaaaagatgtaagacatgtgcctgacatgcgcctgaatctaatctcggtaggcaaacttgatgatgccggattagtaaactactttggagaaagtagatggaaattggccaagggaaacttggttgtgactcgaggaaaaagggaaggctccttgtatgtgatgcaaggaaagataaatagtggagaaaccaattctgttcaagatggacatagtttggaactatggcacaagcgtctcggtcacatgagcgagaaagggctccacattttgaacaagaaaggattattgaccgggttgaaaggccaagcgttggagagctgtacgcattgcctagctggaaagcaacaccgtgtttcgtttgtgagaccggatcaacccagacgacgcaggtatattcttgacctcgtccatacagatgtatgctccatgactgaaagatcacttggtggagctcaatattttgtttcttttattgatgatcactcccgcaaagtgtgggtgtatttgttaaaatttaaagaccaagtcctccaagcctttaaagagttccatgctatggtggaaagggagactggcaagaaattgaaggtggtcagatcagacaatggtggtgaatattgtggtccctttgaagcctattgtagagaagctgggatccgacttgagaagacgcctcccaagactcctcaacggaatggaattgccgaaaaaatgaacaggactattgaagaaaaggtccgatgtatggtatccaatgccggattgccgaaatcattctggggagaagctgtcagaactgctgttgacttgatcaacctctcaccatcacggccacttgaaggagaaattccagaagaagtctggacaggtcggaaagcggcctatgatcaattgaaagtgtttggatgccgagctttagtgcatatccctaaagatgaaagggcaaagctcgatgcgaagatgaaagaatgcatttacctcggttcgccaaaatccgagttcgggtttcgactttgggacccaatcaacaagaagatagtgagaagtcgagatgtgatctttcatgaaaatgagaccattcatgacatctcgaaacccaaagttcgagtttctgttcgacgtgaggaacctgttcctcctgtccaagctgaagcagggggagaaaccattgaagaaattaatgatgaccagcaacaagctgatgaggaccaagacactgaggtccaagaaggtgatgaaatccaagatgataatgatgaaccaggttcttatgttgataatgctgatggacagacgagatatcccattagagaaagaagaccttctacaaggtatccacttgatgaatacaccgttattgctgaagacggtgagactcagagttatgatgaggctatgacaagctcagagaaagaagaatgggagaaagcaatgcaggaagagatgaaattcctacataagaatcagacctatgaactgactgagttgccaaaaggaaaacgagctttgaagaacaagtgggtatataagatcaaaaatgatgagaacaggcaaaagccaagatacaaagcccggattgtagtgaaaggctgtaatcagaagaaaggagttgactttgaagaaatcttctctcctgttgtgaagatgacctcgatccgaactgtgttagccatggcagctacaatggatcttgaggtagaacagatggatgtgaagaccgcattccttcacggtgagctggaagaggaaatatatatggagcaacctgaagggttccgagctccaggatgcgacgacatggtatgttgattgaagaagagtctctacggcttgaagcaagcacctcggcaatggtacaggaagtttgagtccttcatgacagagcacaagttcatgaagacggaagctgaccactgcgtatttgtgaagaggtatgagaacggagactttctgatccttctgttatatgttgacgacatgttgattgtagggcaatgcaaagagaaaattgttgcattgaaaaaggcattgagcttatccttcgctatgaaggatcttggccctgcaaaacagattctcggaatgaagatcatccgggacagatcgaagaagctactgtggctaagtcaagaaaaatatgttgagaagatcttgaagagattcagcatggacaaagccaagacagttagcacccccttggccggacacatgaagctgagtaagaagcagtgtccgaggtctgatgaagacaaagatgagatgctgaagattccttaccaatctgccgtcggaagcttaatgtatgcaatggtttgcactagacccgacctggcatatgcagttggtgtggtgagccggtttctatcgaatcccggcaaggatcactggaaagcagtaaagtggatcttcaggtacctccgtggtacaaccaatctatgcctccaatttggagaaggaaaagtcgagttgcaaggctactcagatgctgatttggggggagatgccgactcaagaaagtcaacaactggttatttgatgacatttgcaggaggagctatctcttggcaatcaaaattgcagaagtgtgtgtcactttcaacgacagaggccgagtacattgccgtgactgaggcaagcaaggaaatgttgtggatgaagaagttcctcatggaactcgcccatgaacaagacaaatttaagctgatgtgtgacaaccaaagcaccattcatctgacgaagaactcgacctatcacttccgaacaaaacacattgatgtgagatatcactggattcgggatgttgtggaagatggacaactcgaacttgccaaagtacacactaacctgaattggtcagacatgatgaccaagactgttccaacatggaagtttgaagactgttgcaaaggtgccggtttgataactttatctaattaaatcggaaagggggagaattgttggaccatttcctctttaattaagagttggtagaattagtgggttggtgtagtaggtgtaatttaagagttggtagtgggttggtgtagtaggtgtaattgatgtagtaggtgagcatccttggttggtgtggtaggtaagccatcttgaggctataaattggcaacattgccaatggtttcatcatcccaaaaattgaagcattcttcaaagcattgaagaagagttgtgtgggtgagagaattcctctttgaagagagtgagagaattcctctttgaagagagtaagagagttcctctttgaagagagtaagagtgttcctctttgtagagaaagagagagttccaccatattggtgagagataaatcctcccagtgagagataaaatttgtaagccatccttagtgggtgagatatatattttgagtgtatacctctagtcttactagagagatcatctttgtaatcctactttcatagtggatgtttttctggactagtgtcccgtggttttactcttcacattgaggaggttttccacgttaaaattgttttgtgttctctaggtgatatttttctgcttctatattttcccatctcctcacagatttacttcgcttccgcaaatagatagggttaccgacccaacaataataaggattaagcttactgccgcagagaaatttatcaggacatcttctagtatcatgtccaaagaagtcagctcacaagtaactctaatcacagaacatggtattgaagggaagaaaaaaagttaggtaagggataggaatgccaaaatataagttgaaattaggaaacaaatgttcttaaaaacatttttctagtctaattatctcttttaaatatttagtagtcaatatgcaagtcatattttatgttttctaatggtcagataacaatgtaaagttcatggtgaaaacaaaatagagaaaatcttttttttttataagctaaaatagagaaaatgttattaattagtatttatacgaccttttctgatttgtatagtttaaaaatccgaccaagctccggattgttcagatactcttccttcttcctggcagcttgtgcctcaatcatcttctggctagctccaaacattaacctgctgtccacactgcttttgtaacccactacaacaaaatagatgtaaagggaaccaataattggattgattagtgaaattaatatcttcggaccaaagtttgcaatcagtttactcaacacaaatcttactgacatattgttcttttattttccattttctttcttcataaaatgattttgagaggatgaataaaataagtgtgtatttgatttctattttctaaactatttttagttttcaaaatacaactaaaaaagttgttcaaattagcagctggtagtaagtggtgcaaggcacaaaagagtgtagaattgatggagaagttgaacaagatgaaaatagaagaatatgagaaaacatcacttaagtagtttttggattttaagacacttgttttagaaacagttttcaacatttaatagatattggatgagaaactgattgttgagtagtgtagaattgttctagcaaacaaattttaaaaccaaaaagagagaagatgacttactgggagtaataacttggtgaatgactgcaattagtgtgagcatatctcctggcacaagtaacaagccatgtagagaccattcaaagattttaacattgattgctctagatgcatcatggatcacaaccacgctttgcccttccatgtcaatgacttcaatttaccttattaaggaactccaacttttgctgatttccagctgtacatggagtggccattgatggtttccagcctgttccagccacccaccaattccagccatcaccagctgtccaccaacttccagctgtgcactagttgtctgccacaaattctccaacgtacaccattcttcaccctataaatagaggtgcaaacctcacttgtaaatcatcaatttgatcaaccaaaacaccaagagtgaattcatccgagtagtgagaattcctagtgagtgttgtctgagtttgagagttattttcattttgagtttgtaaatctctgtaattctattcttgtgagtaatagaagtagtttttctctcaacttcgtgtctaccaacacccagttgatcctctggctcccaacaagtggtatcagagccacgtttgaggtgttggtcgatttttcgtttttctgggttttctgagttttgcccgaaattcaattttgattgcaccattggattcgtctcgtcgaaccgagtccaacgcaacaaacgacgaattaatcggagttcaaacgagcccagaaatcgcagtcaaagtttggtcaacgctgccggaagttacagttcgtcgccggagaagaagaccggagttactgttcctcgccggaagttcgtcggagaagacgaccggagttgctttttgcaccccctgttttgataagttcacccttactttttgcaccccctgttttgataagttcacccttatttttcgcacctcctattttttgataattttgaccctgaagtgtcaattttatcatttttaaccgttccggatgtaacggtaagttccattttgcaatattcaaccttgttttggtaaattaagctactataaggtgataatgaccacagaagagtcaacatcatcttccggagccatgattatgcttactgctacaaattatacgctgtggagacctcggatggaagatctcctaagctgtaaagatttgttcgatcccatagaattgataggtagaaatcctgactctgctaaggagttggagtggaagaaattaaatcgaaaaactattggtcagatccgtcaatggattgacaatagtgtcttccaccatgttgcacaggagacagacgcatacgccctctggaagaagttggaggacatgtaccaggccaagaccgctcggaataaagccctgttgatgaggcgtttagtcaacatgaagttaaaaagtggaacttcagttgccgagcataccagtgagttccagagcttggtcaatcagttgtcgtctgtagagatgccacttagcgatgaagttcaggcgctgttactactcagttcccttcccgatagttgggaaacgctggtagtatcactcagcaactcagcaccggatggcaaacttaccatgtctatggtaaaggatgctctatttaatgaagaggcaaggagaaatgacatgggcacagatcagacccatgcccttgtcacagaaaaccgggggaggcaacaaaggagtagtaaaagcaaatggagaggcagaagcaagagcaggggcagatccactgatggcagaaaaccaacatacaagtgccatcattgtggaattgaagggcatatgaagaagaactgctacaaatggaaggaagagcaagcccagagcagttcgcagccgaagaacaagggtggagaaacattagttactattcttggagatgtagctttttgttctacccataatgagacatgccttcacgtctcacgagaagacacagaatgggtggtagatactgcagcatcctaccacgtgactccccacaaggaatacttcacaacataccaagatggtgactttggagctgtgaagatgggaaattccagttcctctgggattgtaggaattggtgatgttctagtaaagacaagttctgggagcacaattaccttgaaggatgtccgccatgtgccagatcttcggctgaacctattgtcaggaatagctcttgataaacagggctatgatagtcacttcagtaaaggcacatggaagttgtcaagaggcgctatgatagtcgcccgaggacatatttgtggcacgctatacaagactcatgtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtctaccctaataaagaaggagcttatcaatgtagacaaggatgctgcactagatccttgcaattattgtctgtttggtaagcagcatagagtctcgtttaattcctcttcaacgagaagatcagagttactcagtctggtacactctgatgtttgcggtcccttagaggttgaatcactcggcggcaaccgatattttctaacattcatcgatgatgcttctcggaaagtgtgggtgtatttcttgcggacgaaagaccaggtattcgattacttcaaattgtttcatgtcatggtagaacgtgaaacaggaaagaaattgaagtgtcttcgatccgacaatggaggtgaatattcttccaagcagttcaatgtctattgcagatcatatggcattcgacatgagaagacggtccctcgcacccctcaacacaacggtatagctgaaaggatgaaccgaacaatcatggaacgtgttcggagcatgctcagtatggctaagctgccaaagccattctggggagaagcagtcaaagccgcctgttacttgatcaaccgatctccatcagtaccattagactttgaagttccggagaaactttggtctggaaaggatccatcatactctcacttaagagtatttggatgtttggcgtacgcacacgtatctaaggagctcaggcagaagctagatgcaaggaccactccatgtattttcataggctatggagatgaagaatttggatacaggttatgggatcctaaggagaaaaaggtaatcagaagtagggacgtggtgttccatgaaagccaaacaatagaagatattgaaaagcccacaatatctcagaagtcaaatgttgcagctcaggtgccagaagcagcaacagaaccattgataagaaatggtgatgcagtgccagaagatattccagaagtagaaaacaatgaggaagaagatggtgttgagcagggggagccacaacccgctctgccagatgttccaggaccatcacaagacccagatgatggtggatctcctcatattccagaagttcgtagatctgaacgagatcggattccatccagaaggtatccagaatctgagtatcttctacttactgaagatggagaaccagaaagtttccatgaagcagtatctcataaggataaagaaaaatggctgctagcaatgaaggatgagatgaattctcttgtgtagaatcaaacttatgagatcgtagagcttccaaaagggaagaaggcactgaaaaataaatgggtgttcaagctgaagaaagatggcagcggaaaagtggtgaaatacaaagcacgacttgtagtcaaaggattccaacagaaaaaggggattgactttgatgagatattttcacccgtagtcaagatgacttcaatcagagtcatacttggattggtcgcaagtatgaacttggagcttgaacagatggatgtgaagacagcttttcttcatggagatttaaaagaagaaatctatatggagcagccagaaggttttgaggtttcaggagaaaacctcgtatgcaagctaaagaaaagcttgtacggtctgaagcaagcacctaggcagtggtacaagaagtttgactcgtgcatggtgagtcaagggtacaagaagactgcagcagatgagtgtgtctacattcagaagtttcctgatggaaatttcgttgctcttctactatatgtagacgatattttgatcgtgggaaaagatgcaacgaaaatcaatcagctgaagaagaaactctctaagtcttttgacatgaaagacttaggaccagctcaacaaatcttgggaatgcagattactcgagataggaagaatcagaggttatggctatctcaggagaagtatattgaacgagtacttgaacgtttcaatatgaacaatgccaaacctgttagctgtccattagctaacaatttcaagttgagcaagagtttatgtccctcatccaaggaagagatcggggagatgtcgtcagtaccatattcttcagctgttggaagtttaatgtatgcaatggtgtgtacgaggcccgatattgctcatgcagtgggaacggtgagtcgttttctctccaatcccagaaaagagcattggaaggcggtaaaatggattctcaggtaccttaggggtacaacaaagatatgtctttgttacgggggagctgatccaatcttggaaggttttacagattcagatatggctggagatcctgatagtaggaaatctacttcaggattcatttacacttttgcaggaggagctgtttcatggcagtcaaaactacagaagtgtgttgctttatccacaaccgaagcataatatattgctgccgcagaagctggaaaagagatgttgtggttaaagcgttaccttcaagaatttggaatcaagcaaaaggagtacaaggtacattgtgacagtcagagtgctctagatttgagcaagaattcaatgtaccattcccgaacaaaacatattgatattcgctatcattggatacgtgaagtaatggatcgacaactgttgagactagtaaagatccatacaaaggagaatcctgcagacatgatgacgaaggtggtgactcgagagaagttagagttatgcagagacatagttggaatgttttctccagatacagctggagggggagaattgctgatttccagctatacatggagtggccattgatggtttccagcctgttccagctgtccaccaacttccagctgtgcactagttgtctgccacaaattctccaacgtacaccattcttcaccctataaatagaggtgcaaacctcacttgtaaatcatcaatttgatcaaccaaaacaccaagagtgaattcatccgagtagtgagaattcctagtgagtgttgtctgagtttgagagttgttttcattttgagtttgtaaatctctgtaattctattcttgtgagtaatagaagtagtttttctctcaaattcgtgtctaccaacacccagttgatcctctagctcccaacaactttttattacacaagtggttcaaggaaattgtgtaacaaaagtaagttctagcagcttattaaagtatgagtttcccaacgagactttgtgttgaagagtgtgtgtccaaagtgattttatcaatgagtaataatatcttaagataggatttcttgtgcttatcaagtatcctaagtaaccccttaaaaatggttattcgggattggtcttaatggttctgctttggcaaaatctaagctcattgctctatagctttcgatgagaacgaatgacttttcctggttaagtaacgaaattaccaagcattgccatgtagattaagtattttcatattattatttcattacttctatttgttctctttcaatcattttgtcatggaactgcgacatatggtacatgtgttttttttagaaagtagaacaaagttgtgatgacgtgtaggcataacgtataaaacaaatagcgatatgtgaagtgggaactcgtaataaaagagcaactgaaatttgaagtatgtggttgtactaatgtgcaagatttgattctacattgttttattgctaaggatgaatttggaacaaatttgatgctaaacaaagacacttaaaatcatagttattaaaattggatcgaatcggcctttggaccagttggaccgagaatcggtagcaccatcggtccggttactattggaccggttatgtagttgacccgatcaaaccctgccaaaattgatcggtcgaaccggtctgggccggtcggattttatttttttggggctgatttttttaattttttatttattattaccaatagttattttgaattttggagtatgaatgaacttttcttactcaaataatgttagttatatacttatatataataaataaattttaatatatattaggtcaaaccgattcaattactaaatttgaataacttagaaaaatattagttacattaaatctttcactattcacccaccaccacaacaagatatatcatcataggctagaagcatggaactataataaaaaaaattaaaaataatgttgaacaaaacactaaataaaataatgttaaacaatattacaacatactaaaagtgtattttaagtgaattttactttatttctagttaattgaacaaaacactttaaagtcttaaaaaatattagaaaatatcaatagattattttttaggtggattaggtgagccaatctgtttcatcaataggttattttccttcattcaaggcccacaagaaatgctattatttatctctttttttgtattattttcatcttcatttttaaattagatttaatatttctttaaaaaaatatttctcatatagaattaaatatttaaaattattcatttatcataaattttgttatataaaaaatatatttatcatgtacatttcaaaagctaaaataatagttaattgcttaattataatcaagacactaagaaaattatgagaaaaaaataaaaacttaaagaatcaaaatgtatcaagtcatctacttatcttccttattttatgtcatattcacaataacaatcacaataaactcattataattattttataattgatataatatgctatttaggggaaaattaaactttaaaaatgatattactaaagtaaaaaaaacaaaataaaataaactccataaatcactttagattttaaaacagaaatttgtttttcctaaagcgggtctggaacgtgaatttgagttcactagttcagaatagagaattggggactgatctagggtttgtgactgtacatgctataaatataaattattgagcaaagaaggagtgtctctctttttcactcactctgcactcactactactcagcactgccactcttcaatcacactaatggctgtcaccttctcagatctacacaccgaagagggcatcaaatccctcgatcaattcctttctgggaagacctatatctctgggtaacactcataaaatcaactcaatttttatgggaaaaaattgattttttactgtttctgacatttgctttattgaatttgtatatgggtttcgagttcagggatcaattgacaaaggatgatgtcaaagtgtatgcagctgttgtggaaaagccaggagaagactcttttcccaatgctgccaagtggtacgatgctgtctcttctcaacttgctccaaggtttgttcctctctcacttgttttcttttttcctgctgcaaattatagttttgtttttctttattagattttgcgaattttgatttttgttaatttcgatttttatttgagtagcttccctgggcacgctcaaggggttagattcagtggcgctgctgctccaactgaagctgcacctgccaaagcggtatgctttttccttaattttatattttgttgttgccttatttttaaaatcgtttgttatattgtattaggattgtatttagtagatccactgtttgtaaagtgctgattagcttttgctaatagcacttcctttctactgtacacatgcaaataggatagcgtactctggaagctttatacagaggttatataaaaaccttttttgtaactgtcaaagtaatgaaaaacagattcacaaaatacaatcagagttccttcttctctctttacttgtctctagtttctctctaaaatggtatcatgagctaattttttgcactaatcgtgcattcatcttcaagatcctgttcatgcgttgtggattctgttcgtcactttctgttcaagatcctgttcgtcactctctgttcaagattctgttcgtcactttctgttcaagatcctgttcgtcactttctattcaagctctacttccgcttgtcactttctgttcgtgattttctgttcttgcttggttactgttcatccgttcgtaacgtccggcactgcttcactccgtaactgttcctactcatccatacatctacgtttctgcttgatcttggtggagttcttcttttcggcactgtctgtcttgtttggagtcaattttggcctctttattgttcgtgattaggtcctggtgctgttgtttggatctccattgattgttgactggtgcttcgatacttgctttcaattgatttctggtactattgtttgcctagtgttgtgctttgcttctgattgttaagaattctctgctctatttgttggtctattcatggcttccgctcctgtttcgcatcaatttcccacttctgttgctgagaaattggatgattctaactacttacactggcgtcaacatgttgagccagttattaagtcacataaactgcagaggtttgtagtcaatcctgtaattccgccgcgatatctcactgaaagtgattcaatccttgacaaggttaatccggagtttgaagcttgggaggttcaggaccaaactcttcttgtttggcttcagtccactctctcaaaatcagttttgtctcgtgtccttggtgctgaacattcttatcaagtgtgggacaaaattcatgaacatttcagtctacacactaagtcctgagctcgtcaattgcgttctgcaatgagggcagtttctcttgatggcaagtcaattgatgaatacttgagaaagattaaaggctacgtggatgagttagctggagttggagttccagtacgacatgaagagtatgtggatgctctgctggaaggtcttccttctgattatacatcagtaatttcagtcattgaagggaaaaagaagacaccatctattgctgaaatagaagcacttttatatggacatgaaactagactcaacaggtataacaaagaaggtcagatattaagctctccttctttgaactacactcaaggtcacatgaattctagaaattcctatagccgaagtgttgctggacgtggtagcttttctgataataacactggacgcagcaatggaggaggatttggcagaggtcgtggaggtggcagatttgccaattttcaatgtcaaatttgtctaaaatttgggcatactgcaaatgtgtgtcattataggtctgatatgaccttcaagccccatgaatctcttgctttctttgatcctgccaccaatcaatccattccctattcagcaggatctagtaaaatgtctaatacctggactaaccccaattacaagccttcaactcaaactggaaatcaacctagtgctatgttgactaattctagtggtgatctagctggttctacttggattccagattctggagctagttatcatgtgactggtcagtcacaacatatcaagcaatttcagcattttgatggaccagatcagatctttattggcaatggtgaaggtttgaatattaatggtgctggttcctcttactttatgtctcccaataacagtcatttcacctttaaactacaaaaattgttacatgttccttctatttccaaaaatttactaagtgtcagccagtttgcaaaagataactctgttttctttgagtttcattctaatttttgtcttgtgaaatctcaggagacaaataaagttcttcttcaaggatctgttggagctgatggactgtactattttcagaatattcagctccaacacacctctcctcagttgctgtccacttcagctactgactcagcaaacactttgtctcagcagtctaccactgtttcttctgattctagttctttttctcctagtgctattcatgtttggcatgctaggttaggtcatccaaacaatcatgtaatgaagcttgtactaaacaattgtaatgtttctcatttcaataaaattgttccagatttttgctcatcttgttgtatgggaaagtcacacagattgccatcttccaagtctaatactatttattctcccttagaactcatttttacagatttatggggtcctgctcacttaacatcttatgctggtttcaaatactatgtgtctttcattgatgccttttctagatatacttggatttttcctattaaatccaaagctgaaactgtgtcagtttttcagacctttaagtctctggttgaattacagcttaatactaaaataaaaagtgtgcagtctgattggggaggagagtatagacctttttcaaatcttttaaactcttttggtatctctcatagactcatctgccctcacactcatcatcaaaatggagtggttgagagaaaacacaggcatatagtggacttaggccttactttattgcatcatgcttctttacctctgaatttttgggattatgcctttaccactgctgtttacctcattaacaggcttcctactgcttctcttaattttgccatacccctcaccattctttttcaaaaagatcctgactttaagtttctaaaaacctttggttgtgcatgttttcctctcttaaaaccttatcacactcacaagcttaatttcaggtctcaagaatgcttatttttagggtattctaattgtcacaagggttacaaatgtctgtccccttctggcagaatttatatatccaaagatgtcctgtttaatgagcagaaatttccctattctgatctgtttccttcatgtcctaatacagttagtgattttaatacctactttactcttaatcccaatctgtctcctcctgtgcagtcagcacttttcgatacacagcctttcctttctacacctcaatctgtaccaactgtatcacctggtttctctcctataactagtcagcatactgttgtttcctctcctgtgtcacagccagctactgtatcaacttctgacctaatttcacatgtctcttcagagactgccactgtctctgcaccacctactgatatttctgcccctcactccacttccaataatattcatccaatgcaaactaggtctaaatctggtattcacaaacctaaattacatccatccttgtttcttgttcattctgagcctaaaactgtcaaacaggcccttgctagctcagattggcatgctgccatgcaacttgagtatgatgctttaatgagaaataaaacttgggatttggtttctttaccagctaacagaaaagctattggttgtaaatgggtgttcagggtaaaagaaaatgctgatggcactataaacaaatataaagcccggttggtagcaaaagggttcactcaagttcaaggttttgattttcatgaaaccttttcccctgttattaaacctgttactatcagaattatcatcaccattgctctctcacatggctggaagttatctcagcttgatgtcaataatgctttccttaatgggctccttgaagaatctgtttatatgagccaacctcctggttttgaagctgctgacaagtcattagtttgcaaacttaacaaagcattgtatggtttaaagcaagctcccaggcagtggtttgatagattgaggtctactttaattcagtttggttttgaagcaagtaagtgtgattcctccctattcatttacaaacagcagaagcaagttgtctaccttttggtttatgtagatgacatcattattactggcagctctaatattctaattcagcagcttacttccaagttaaacagtgttttttcactaaagcaacttggtccactagattatttcttagggcttgagattaagtacttgtccaacaattccatcctcatgactcaaagtaaatatatcagagatttattacacaagactaatatggctgaagctcactccatctcttctcctatggtgtcaaattgcaaactgtccaagcatggagctgacatttttcctgaccccactttattcagatcagttgtgggagcattgcagtatgttactcttactagaccagaaattagctttgctgtcaacaaagtgtgtcaatttctggctgctcctcttgattctcactgggctgtagttaagagaatattaaggtatcttaagggtactatttctcatggacttttgtttcagcctgctgacttcaataaacccttatctcttcatgctttctgtgatgctgattgggcttcagatgtggatgataggagatccacctctggctgtgctatttttcttggttcaaatctagtttcctggtggtcccgaaagcagaaggttactgctaggtccagcactgaggctgaatacagaagcctagctcaaacctctacagaacttacttggattcatgctctcctgactgagttacaagtttctttcactattcctgctgtattttgtgataatcagagtgctgtttccattgctcataatccagtttttcacagtcgaactaagcatatggaaattgatgttttctttgtacgggagaaggttctagctaaacaactgatagttgtgcatattccagctctagatcagtgggctgatgtactgaccaagccattgtcctcaatcagatttgaatttcttaggagcaaactcaatgtcaagagtttttcttctgaaaactctccaccttgagtttgaggggggatattaggattgtatttagtagatccactgtttgtaaagtgctgattagcttttgctaacagcactccccttctgttgtacagtattaggattgtatttagtatattcactgtttgtaaagtgctgattagcttttgctaatagcacttcctttctactgtacacatgcaaataggatagcgtactctggaagctttatacagaggttatataaaaaccttttttgtaactgtcaaagtaatgaaaaacagattcacaaaatacaatcagagttccttcttctctctctacttgtctctagtttctctctaaaatattgaaatgcatgtataaatcatttagtatttgtctttttttagtaatttagggcgctcgatagctagacttttaatttatattaaaatatgtgaaagttacatgggatttgttgttaatacttaatatgaaactaatagcaaaagccttatcttatcttaattagagtgactgtgtgggggtggttgattgccatgcatattgctattatgagggagatatgggaatgagtagctcagtagaaatgttatgtttattttcatacattgaaaaggttgataaatgtttagtatgtaccccattgtccggaaacttcacgctatacacaggtaagggggagggatattgtatgtagtcttacccttgcatatgcaaaaagactgttttcggattcgaacccatgaccaacaagtcaccaagacacaactttaccgctgtaccagggctcgccctcattaaaaaggttgataagtgtatgctaaaaaaatttaagccattggattatgactgcaggaccttgcacttgcagttactgttctgactgcaggcaattcggttccagttagttcatataagagataggaattggagattgcctgcaatcagtgtgtgaaagtagaatctttactggctattttgcttttcaaacttcataaatgaaatataaattaaagaaacttgagctgcaggatcatgactgcagagttgactgcattaaaattgaatgtggagaatcttggtctaaaagaaatggaggatgctgacaaccattgtctctctctttctatatgtgtgtgtgtgatttttgatctggattttccgcatttaaattttatgcaatcagtcccagtcatgatcccacgcaatgttattagactagttcagggcacttgatcactgattgaaccaatgactggatgaactggtattaaaaaattataaaaaaattcatagtatgccactatgccttaaaaattataaactgcatcacacctcttatttttatctttcaatattttgatcctgtaacatgctaaatttaaaactatcactctgacaaaaagagaaaacatgtttacataagtgaaaagttaaaaccttagatttgcagttgaaatagaagacaaagcaattagggtgttattttcttttcagaaaaatgcttccataatttacttatctagcatctatttcttttataagatgtgaatttgaaatcaattaatccatttgggtgagaacacctaactcgaagtactttgatagttttagaaagaacagagcttgattatgtaaccaactaaccatattcatatgtaacataacatgtttactatatagttcctgaacatgataagtattagccaagattacaacatcgaaggcacattttagagttgaataacactataatttgcttttgacttcagatagttacttaagttttatatcccatgcagagtagtagtagttttgattgaattcatcattttttttggtcagcaagattgaattcatcatgatgtgattactaagtgaaattgttgttatctaagataataatattgaaatgaatggaagtacttgtattgtaaaattatataaattgacttttgactttatagtgtacagatatacttattgtgaagtgtaagatattattgtggttgtactgaagctgctaagtgaactaattcaactaatttgatcattgggatttgtttgaatttgtcaggctgccactgctgaagaagatgatgatgatcttgatctctttggtgatgagacagaggaggataagaaggcagcagaggaaagggaggctgctaagaagcctgccaagaaaaaagagagtacgatttctttaatgtctcctgactgtaaattgtaattcgtggtccatgaaacatttctcaattcccagaaatataatattgatagaagccataattgaatttgtctaatcctcctaaaattgcatagttatttggggaaagtaggaatgtcttgttatatggtagagtaataggttgaaatttatgatgactggtcagacactcacgtggactattttcttatcgctagatcttttttttttttgttgaaagcctttgacactatgacttaattgacatttataggtggcaagtcttccgtccttcttgatgttaagccttgggacgatgagaccgacatgaagaagctggaagaggttgtccgcagtattgagatgcctggtttattgtggggagcatgtatgaaattttcttaaacttttctcttgcatatttggtgcatttaacttctttcaaaattatattttatctaaaatgtttgtttctattggtacagccaaactggttccggtgggatatggtatcaagaagttgcagatcatgatgactattgttgatgaccttgtatctgtggacactctcgttgaggaacgcttgacagttgagccatgcaacgagtatatccagagctgtgacattgttgcattcaacaaaatttaagttttcttgttgacttttgagtttggccattttcaagaggctgatcagtctactactctttcatcgttcatgtttggtctgtttcaatggtggttttgttggaaaaattgtgagaagtaaaaagatatatagatatattaagtatccatgttaagatgtaactttgaatattatttcttgaattagatttatgggattaagataactgaacgatgtgcttccatttaaattttgataagtttctcaaaacctgtcaatttcattgaatgtgcttcagggtgtatagaataaaaccagtttggtttttgacttattataataattatatcattttcttttcaagctatttattggtgcttaggggttctcgaaaccaaccaagaatatgccatcgtttgagtgcatgccttcaccaacgccaattttgctgaccttagcttcatcagcaccaccaaacaatcattattgccaccaccgcttacaacaatacccaaacaaattttgatttgattccaagaaatatcatacatattgttgtagtaaatactaaataaattaagggatcatttgtgtatttcaccaaatacaatttccttcaaatttttttgtcatgttagcctcgattgttttgactatatttaatggaacgattgctttgcctgttaaaacccaattcagccaattagtttcaacttttaacattcacataacttctgcagttacaaaacactgatctttaccaaattctttgcgtgtcttctcattatcacctttgttttgtaaagttcatttgttcggatcggaactttatttgatttagtatttaataattggaattttgatgtttgaaaaggtgaaagatgatatcgaccctccataatttcagaaaatgtaatggtacttgacttaattaccctttattgatgttcttattcagcaaaaaattattattattttgtcagcataaaaatatattatttaacttagtggatgtattactattaagagtcaaaaatatttttttaaaaaacaatatgttcctttttaataacaataatttttcttctttacaatgactaattgtagaatagaaattaaattcagtaagaagctctactttcaaacaattgctcaacttcaaataagaaaatatcaaaatatagtattagttataattctttgcaagacattaaattgtcctaaagcactatcttacatttgggggcctgtgataactaaatataattgctctcatttgtttggaacaagaagttgcctcgactattaacaaaccacgaaaacttttattttcttgatgcatcaggattcagaacgaagtagccttacataatacatagtaagtaagggtgtattatgaaacataacactatttgatcataataaaaagaatatttttacctatcaattttttcattcaaatctataaaatattaaaaacaatttgtctactaacattagaatttagaaatgcatattgaaaaagtagtaaagataaaaaaaatgctttaattgcgggtcaaacaaatgtccaaatcagaagtctttagtcacatttatttatgagtgacataaagttagttggaaaacttaaacaattgggactaatgcaattatagggcaccatcaccttgtcgtgctatatagtatatacatatatccatggtccttcctatgttggtggatccattcataattgatcttatcggtgacttctatcatctatgatctgtctctcgtacatggcaacacaaattttaaattaaattttaaatatttttaataaaaatagttaaatttaagtgaattgtcagtaaaatatatatttttaaagaaaagagtaaactctcgtttttaatcattaagattataaactaacgggagttcaatttaatggaacgtgctagtctcatataacctacagttaaggtttgatatcaaattgcgtctcaaatatgaatatttttaaaagagaatatctaagagaaattatataaaaaattaagattaaagtgttatgcattttgttcattaagatttttaaatttctttttctaatttacaaaaatatgtttttaattttttttactgttattttatattaaaaaactgaagaaaaacattaatttttaatgttaagaattagtaaagaaaaaaattgaaatgttaaagactaaaatatataaaaaggtaatttcaaaagacgattatgtcaaaaaggaataaaggaaacgtgccttttagcatgtagcatgggcaaagtagctgttgatgatctaactcgatatattattgccaatagcaagtaatatctgtttgttttatattaaatacatagtttaaattcattttttatttctataatattttgtgagtgtgtaattttagttccaatacaaatttaattacacatttaatctttacgattttcaaaattgaataattgtaatctaccactaatctgcattcaaaattaaatgataaatattaatatgaccgtgataaataacacgtgtgattaacttagttacattaaaaaaataataatatggaaaataaaatataaaatttgctttaatatattttaaaaatcatttctttcaaataattatattttcaattttcaaaatttataaaaaaatttattttttatttttaatattattttatttcctatgtaaataagatagtcatgcattttattaatcacatacacatcttgattttccatctaattttggatgacaaactaatggtggaataaaattgcttaattttgaaaatattaaggatcaaatatataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattatcggtgcataatatttttcttgtattatttatctgtcttaaaatgaatatcaaagattaaaaatagtgatttcaaatttgaatataaatttaaaataaaatcttttacaaaaccaaaactaaatataattatttcaattttttttaaaataaaaacataaattaaagaaactaaaataaatactagatcaatgtatacatttaggagacatttcataaaaagaaactttttactttatcgaaagtaaaaaaataaattatgtttaaggggtatttggtagaaagaaaattcgtactttctcgagttattctaaattcgctatctaattaattcttatcgataaaaaaaaaaatccaactcatccctaaaactatatgagcagtaaaaagggtaataaattcataacaaaataacacaaaaactaccaaacaacacacatgataataattaataactattccgtgttttgttaaagtttccattcaaaaagtttgaaggtaacttctgtgactgcatttctgcatcaaacgcggtaaaaagatggcgtgttttaataattattccttagaaactgctgatagtttgtgttagaaattccactaagtttttttttttttttttttcnnnnnnnnnnagaaattccactaagtttttttttttttttttctcccactacgaattttactttattttatgatataaaagaaagagtcataaattctgaagtggtaaaaataacgagactttttcgtcagtggaacaaacctcagagaaaggtcttcttctctctttctctctctctttcccccactctaagaatcttacggtactaagctccgagttcttgcttttaatttgtctttttcattttttaagttcactatgatgaatcctgaacctttctgctctcctgcaattattttattttattttttcagttttttattttttatttttatttttgcggttgattgtgtatgatttcgagcttaatttggccattggagtatatgggtattgattgattgaaaccccatatgaaaataaattgtgctttattgacaagttctttgttttcttaattttcaattgggggttagttatgccttctctctactgttactgtctccgaggttatgattcatgataagttatctttgcatcttgcatgaattgttattcctttattcacctttgataaaaaaaataaaattaatccttttaggaaaacttgatttcatttcaatttgtttattatgatgaatatacagagtatttccccctctattgttactgttggacctgttctttgctgtcctgatggccggatatatggctttttgtctgagtaaattgttgtgttgggtaattttgcactgatttctagcatctggtttaatgggttcattcaattgatgatttgcactttgtgatctggttgtgaaattaagggtgcttgcaacacaatttctattggttaaagtttgttgaaattcacaggattattagtgaaagtcattacatggaaggtgagaccagcatcattttgtgagcccaataaatttcagttgattgtaaaaaaaatgtgtcaaaggatgggttgctatcatttccctcatcaaatttgttctagtgtttcataatttgatccaaagatgacactgtagcaacagcttctctgatcatggtagtcttgactcttgacttgtcctggtccaaatttaagcaataggatggtttaatgtgcttttatgtatatacatagccatagctcacttttggtgagataacctgttcctgtgtgttactaagttggtggtggtttaggatatacatattgatactagcataaccaattggcatattgaatcttcatgtctttttgattaattaattcttttttagttctgattctgtgagtatatttgacaaaaaatgaaagttgaattttggtgcagattttacaaattaaattttgttaaaaagaaagatgtcaagtggagcaacacactggtgttatgcatgcagacagccaattgtgcttgatgggagagatcctgtttgcccttactgtgatggaggatttgtacaagaacttgatgagttgcgaggaattgcacccaaccataaccataccttttcgtcacagtcaggagactttcatcaaatgcctgacattttcgatgctatacatgcttttatggggcagagaggttctgaccagaggttcgggcttatggatgccgttgataatttcatgaggcatagaatggccggaagaaactcaaactttgatgttagagggaggtctggttctgtcccagttcctgaacagagttggggtgtttttagttccggtccttatttaatatttcatggtcaagttcctggattcaccttggctgctggcaacccaagaggtggtcctaggcgtgttgattttggtgactactttatgggtcctggactggaagaacttattgagcaacttaccatgaatgatcagcatggtccagccccagctgcacgatcttcaattgatgcaatgcctactattaggataacacaggcgcatcttcgctcggattcacactgtccagtttgtaaagaaaaatttgaattgggcactgaagccagagagatgccatgcaaccacatttaccattctgactgtattgttccttggttggttcagcataactcatgtcctgtttgccgtgttgagctgccacctcaaggacaggctagttcccgtggtactcgaagttggggaggaaggaatgccagcaacagcagcagcagtggcagcaatgatatctccaggggcacagagaacagccatcagaaccatggaaggagaaatccattatcatttttgtggccattccgctcgtctaactctaacaataatcattattctgagactgggggaagcagctcttcaaccactcctgaccagaataatggaacaagttatagcggttggccctttgatcgctaaaagtatcctttcttctcctggataagtacaatttgctgtctaataatgcttgtaatttaaaatgccaaggaaagagtttattagtattgtattttaaaccttagctcatgtaaggaagatagaagtttcttaaaatctttgtacatgaaattgcctggtttgttgaatctctttgaaactttaatgccacacctgccattattcaatttgattgtatcttgctgcttatttggtttgtttggttcctttggggtcttggcagcaagcacaatatgctaaagactaaagagagtgaatttggtttgttagatgaatcttttagccagtgaatgtgaattgccagatcacagattaaggttgcttcctgagataactgcatcatcaagcttatggagtgcactcttgagaatggtgtcaagctaattctctttctgtttgttagcatggttctttcaaaactcattagtgaggtctagcaatggaaacctttaggaaatactttggttgagttgccaaaacaacttggcattttaataacttgggttgaattatggccaaaatactatgggaaatttgtaggaattttgccgtaacaatttaatgtatacatgtcaatgcatgtgttagtcattttggtttatctcaaacaaaagttgagaaaaagtaagattttacatattcaaagattttacattgcatccattgacattattctgatgtatatccaaattaatcatagtcaaaaaatttatattagaatgcgtctcacaatggctatagtcataaatacacaagcacttatgttgtacgttttaaagtcctagtttgctaacccacccatcaacagcctaaataagaatttgctatcatcctttgtgtctaagttggcaggataaagagattcaaaaccctcgatagctgatagtttcaaagcataaattaatggaaaaattagtgtaaattgatacaattatctattttgaaaatgtaaaaatttagtttcatcttaagacatcttattgctgtgagaacttcgacttacacgatgtaatatgtagtgtattggaattttattttagtaatgaaacacggagatagtcactggattgagtctatatatatggaacactaggaatgtagcctagagtcctagactcagatgaatgtgtggtttcttgcgtccaaataatcatagataaatgataacgatccacaagaaaacatatcacatagtgagggccaacttggcaacttctaatgattcatatttatttatttatttatttttatttttaacttactttatttgactttttcttttagataaaagttaaaattattgtagttaactttctttatacatcatatatcaaatttaaaattttaaaataaataaagtaataagaatccaaaagtatttaattgacattacaaaacttaaacttgagaaaattatcttttatgaaacattaaatataattttaaaaataaaataaagaaaagcaaaaagagagaagatcattcatttcttgtttttagtttacataacaataacatggtggattgtgagttttatttgtgttaataacaataaaaaattaattttgaaaaaatcaaatataattaacaaaaaaaaaatattcaacataaatataagttaacaaaagatattttgggtaattaaggttatagtcaactaaaagaaaatgtagataaatagattagtgttcaagcttatttccaaatcatatgaactgtcactatgagctagtaaacatataagttgaactattgaaacattacattattttcaaaatttaacttatttatctgaagattttttattttattaaataaaaataatttttctcaagtttattttttataaatatactcatttggagagtatgaataattatctttctaaacgaaattaaagtgttaataaccccgtatctttgtcatgatcgtgcttttgtgattttgtcatgtacacagaaaaacaaaaggtgggaccctgttggcatgcatgcattaattaccatgcctaggagtcacaagcaacataattctctggcaccaaaggtttgtatatctgtcacaaaaaattcaaacaacatgaagggtcgcatatcaagaggcactacatatatatatatatatatatatatatatatatatatatatatatatatatatattnnnnnnnnntttttctttttctgatcattgttctttcgtactgtttaaacaattaaaataataaaatatttattgtgaaagttataaaaattattaaaaataatataattttatatatttcaataaaaaatccttttttagttatttagtcagtgttgtaagaatattgattgatatttgtcttttttatatatcaatggttatttttgcattgaaaaatattttttggacaatcttaagttatctataacttgagagagagataaatgattaatttaattgatgatatattataataaaaaaagaaagataaaaaaatgaatttttaattgagtgtttaaaaattttgattttcaaaatataatcacttttttgcatttgatgtcgcactcccggggtattgttgtcttcaaaaccccttaaccctacgggaaaatagtttttttttttatagatgaaaagtagtaaaaaaaataaaaaaagtagggtaattgacaaattatacttttctttttattacgttatttattatatgaacttatagacacattaaactgatgagtaaccaggtaaatgataaattttccacacactgcgcaatacgcatgttaacaagttgggtcgctactaattgagttttaaaatcactggctatttttaaattttcctattgatatttaggaaagaaggttggaatttgagatggcaaaagaaataattactctccgatccacgttttcttcatttattttcatgttaatttcaaatgaattcacaaaagattattttcatgttataaattagaatatatattttgaatatgcccttttaatattctctcttagatgtgttttcacacattattttctgcaactagctagccattcaataaagtagatattctcatatcactggttaattgtgtcaatgtcaaccgttagatttggctactctcatatattgctatacaatgaagctggggcagacttaacataggaaggacatgcaggatccaatcaaaccacactactttttatcatatgagattattgggatatttgtagtacttttggctatggaaaattattggaggcaaaatggacacttcacatgctctactctacacaacccttgtattcttttataataaggaaattagagagggaaaaaaaagttaaaggattcacctagcaaacaaaattgagccaactgtgatgctgccaacttggtctaaactttatgagtagttatcattggaagccaacacctagctagccgcaagtgcataaagaaaaaccaagatattttgtcacattaatttgtgtctttatttattgttgttattcttcttcattttgagttgtgattgtgtgtttgatctctaatcaatttggcagctcaggctcactaccacaagttattgcatccatattggggtggaatttcagaccaaaatccaaatgattttgatagtgaaacgatccaaagaatggaactaaaagtagcaagggagtgacggtaagattttaatcccacttgttgatgcttacaagataaggtaaaagtgaatgattcaatgaacgtagtttgaaggtctaaaggaacaaaatggaataacatgtacacgacctttgtctccaaagtttcccctttgcataataaaatatactaaggtctgtttgcataagttttttcataaaaatgaaataagtgtatctcaagcaagctaaaacaagcatatgtataagataaaatcaacatttttagagaatttaaatgattctaaataagttgattctaacttatacataaattaattttatcttatgaaaaaagtttattttatttttattatttttttcttctactaaatttatctaaataaagccttaaattcaataataactgagaacagaaacataaaatgtggaaaaaaaatagccgtatgactttttcaaaggtgatgcaatctctcaattagttcagaaggaactaggcttcttgaacatccaagcagtagtaaaaggttatcctccctcctggaactaattaattgaggtggcttcaccaatgaagatgaattttgtaacaccccggatgtgttatcattagcaatatcataagcgcgctataagcgttaactaaacgcagtgcggaagcgatagaatcgaatttcttgatttcattatgcatggaataaaaaccacatacaaaatatcataaacaagccccctattgatccagataacataacatgtaggcagaaaacatagaaactaaacagagataatcaggaggaatatatttttatacaacatcagaatctctacaagactaggggtgtacactcattccccatacttatacagaatacaagacagatatctctcaagtaaagactcttctgatcttcatctgcagcccatgacactccagtacacgcggctagagcctcctgccctgtggtaacttctctcctctagaagtacctgaaaaccacaaccccacacagggtgagacaaacgtctcagtaagctcagggtcctgggagatcttcccttaccctggtttaccaccaacacaaacatataaacaaaacataacaaagcctaggacactgtcctggctaacaccctatcccagctcactgggtacataaccggatgccctcagcatcagaggtattccacctcactctggctctcaagccatctcagactcgtctcacagagccaagccagaatcatggcttcaatatctcatatcggctctcataaacgtctgacagaggtctcacagaggtaccataacatagtgtccaccctaggacacttctcataccagagaggcaccgccttatcactgaaccagcattgcctgagtcacctacttaggacttcacacacacattgcctgaggaatctctcaactcaggacttcaagagtccagatatggctcatctaagaggccctaggctttcatcccctcgggaagccctctcttagagatacaacatatctgtccactgcctagcctcaccaggacttcctctgcctggggagtcatccacaacgggagcaccgtccaccaggactttctctgcctgggaatagccgtccaggactttctctgcctggggagtcatccacaacgggagcaccgtccaccaggactttctctgcctgggaatagtcgtccaggactttctctgcctggggagtcatccactacgggagcaccgtccaccaggacttcccatcccatgcctaagagagatcacctcacatcggaggcactcaatctcttaggacttccaaacactggcctgagagagatcatctcacacaggaggcactcaatccctcaggactttcaaacactggcctgagagagatcatctcacacaggaggcactcaatccctcaggactttcataatcactggcctgggaatagccgtccaggacttaatcacatatactggcctgggaaatccatccaggactttcataagcactgcctaaggaggaacatccaaactgggcaatccacccttaggactttagtggagagcagtggcacctcccatggaatctcagctattccagggagtcctcaaactcttcctctggctagggaacctcagctagcccgatactattccagtatcctatagattccatcacctgcaatctcaggtgaatcatcaccctcacactatctcagtgtctatcctagggttcatcatacattcacatttctggaacggtctgagtttcactccaagcaccgttcatctagcccttcggctcacaacatataatcaacagtaacagactacatcggcctttcactcaaccgcatgcacataaacatatatacatatcacatggcatgaaatcctcacccacttgggtggcaaacaagagaaagggaataatccccagagcgatgagcttacctggcaagccgtgcctcacagcttcaacctcgaactatggcccgcgtctctgacacccacagtgtcaagccctaacaaggcatacaaacacatatcacagaccatccaggcacataaaccaacattcaccaaatcccaaactgacagttaattcttcatctactcatcattctaaacacttctctcaactggacccagagctaattcaggctctattacagatgggtcactattcatcaagtgccaatttcacaaatcaatcggtaaaacttaactttcttacctcaagacagtcgtggagggctagagaatcacttctctgggcttcaacatccgtgaatcacttccttccccttcaaaatccaagatattgtaaaaatcactgtagcacatccgtgatgctacagtaaacccatccgtgatgctacaataaccttatccgtgatgctacagtaattgctaacgacacccagcacttactaactacacccatgcctccagcaatgaccaaactgccctttcgtaattccgtttacgtaaatccgtttaattacgtaaatatcacccaaaataccttaattaaatttagtgatattacaaatttgagttcctatcagaccaggacattgaagcagaaacaacttcaaaaagttacaacactgtcaatgacaaaaacttgctatgtcaaaacttaaaactacttttcaagaaacaactatgacttgcctatgtttgttgtattaaagattaacataacatgatcatgaaaaaaatgagcaatcaacacatgcaaacatgcaaggctactacatattagctatacctccatacgttcagcaaagtccagggccttcaaaattatttctgggaccaacaatgagagtataagtggtgaagtcagcgtgtatagcagaggcctattgggagatcaagcactgaaaatcaacattatgaaacaataaagaagtagaagacttggatttcatttcataattaaaatttacaaagaagtagaatcgtgccaattcctagcatttcaactgtgcaatatacttgtttggtgaagctgaatacaaaaaggtacaactcacagtaaatcataagttgattgtatcaaatttcagtattatcttttaatcgaaagataagaaagaaaatgaaaaatctaataaaggacatgtcttagtatttccatgaagagtgatctgtgataaacattgttgaaatctagtaactaacatgatactcatatatttaatgttgtaatacacaaaatggtttccataaataggcccgttcctgaaaattctttgacccaggacaaagtgaaaaaaatgggtccctaacttacaaattttttgaaatacaataatattaaaactaagagatggaaaaaatggactcttaatatacaaattttttgaaatacaaataatattaaaactaaaagatgaaaaaaaatggacctctaacacacaaaaaatgggcccctaatacataaatttttttaaatataaataatactaaaactaagggatgaaaaaaatggactcctgacacacaatttttttgaaatacaaataatattaaaattaagagatggaaaaaatagacctctaacatataaaatgaaccactaacatagattttatttttattttatttttttaaaaaaataaattttacttaaactacttgtaaaaaagattttgataaaaaagattttgagccctgggcggacgccctcttcgtcttgccccagggccggccctgccataaacaggttcatattataccatataagattgcaatatatatctagatatttacatgcatgttacaaatgaaacaactttacaagagccagctaacccagttggaaggaagcaaaaaccatttaaaagttattcaaagtgacagtacccatgttaaattaaaaaaattaacatatgctcccgtgggaacactcacatacggatcaggcagaaacacaaaacattggtagtagaagaaaaaaaatataaagtgcaaaaaatggcgcaacttggtgcctgcaaccagtattaacagaaggaaaaaatgaatatactgacagatgatgataattataaacggacagacactaaaatgaataaaaaaattataagaaccaaaatagagaataaaaatttagaaactaaaaagtatatatttaaatattatattgataagctacaagtttataagttaaatattctaattccaataagataaaattcctaaataacaaaacaatatcaaaccaaattttcctcacaaaattaaaatgtgcacggattaagatagtggttagacatcctgtgtttgacaagttgtggaaataatatatcaatatcgtccacacactcgtattgtacagaagaacattgtgtattatattcatagttatggtctctcttcttgctcgtaatgcattaaaaaatgacaattgaaaaaggttcaagtggatccatttcgattaaaaaaactatttgagtggggtctgtagaatttggacagtggcagaaatgggatttcgtcacaagtaaaaaccatgcttgcgttaaaacttaaaagtctgttcaaactgcatgtaattcgtgccgacgcaatttcgtccattaaccacgatgtataatttggataaccgaagcacttaaccaattggcaacgatgatattcactgcatttaattcaaccttccttgggtgactcatcaatttttactgagttgacatgatttaatttttttaatctcaaattaaaaataaaattatttctaaaatatcattattcattaaattttgtcatcataaataaataaaaatcattaagaaattaaaatcaaatgaaagacatttttaaataataatattaaataagataaaattaattaaatttatttatattcaaattctacatacaagtttaattttttttatatatgaatccaaagtgagcaataacttgaactagatcccttaacacgggtttatttaaacttggttagcttaaatcggtatccacttcagaaattaattacccattccttattcttacactttatttattattcaacgcaagttgttcattaacgcgttaaacccataagttctactaatataaatataaatttgcggcatattttgtgttttgtgtgatgagtggcgggttagaacttagaatgtacaatttgcatgttccacccactgaaagcttaccaccaacaatcaactgtagaatcataagaaccaacatcaaatcaaacatattctgatgtctttcattttattcattcaactttctcccctcattttacagagaaggagaagaaacaaactgtctcggtaaactaaaaagatcattcccttcaaaaggagaattccaccccggggaaccagcagcagatgtctcagcagaagctactccaccatcttgcaatccaggcatgggagcattcatgctcccatttgagggcactggtctcattgatgattcagcaacaactcctgaagcatttgagtcatacatctgagcactattgctccttgaaaacggtgaaaatcctagccataaaccgttggaccttggtgaagctaaacttctgtccaaggaccagtctatgttggtataatcaaactgcatggtcccaccagtgctccagtctactggagaagaagcccctgatgggcctgctgatcctagaccggaaaagagtcctagagaagtagcagcagcaagcggtggaattgcacctgttctattccaaatgctattcccttggtgatctactgaattgctgctgccaccaacaaactgttgttgttgaggttgatactgaagttggtggtacatttgattggaattgagatagtttggactgaggcttctagtgctaggagcatgagatataaagtcattattagatctgacagcatctgaactgttagatggataccaactagtagcaatttcaggaggtgatgagctcatgcttgtggctggaacttgctttgcatttacagtctggggccgct

(The sequence listing continues in the following parts.)

That which is claimed:

1. A method of selecting a soybean plant having an Asian Soy Rust (ASR) resistance allele, the method comprising the steps of:
   a. Isolating a nucleic acid from a soybean plant;
   b. Detecting in the nucleic acid the presence of a molecular marker that associates with an ASR resistance allele, wherein the molecular marker is a T at a position corresponding to position 3,275,655 of SEQ ID NO: 1, or a T at a position corresponding to position 3,274,672 of SEQ ID NO: 1, or a T at a position corresponding to position 3,291,351 of SEQ ID NO: 1;
   c. thereby identifying a soybean plant having an ASR resistance allele; and
   d. selecting the soybean plant identified at step c as having the ASR resistance allele.

2. The method of claim 1, wherein the ASR resistance allele is a T at position 3,274,672 of SEQ ID NO: 1.

3. The method of claim 1, wherein the ASR resistance allele is a T at position 3,291,351 of SEQ ID NO: 1.

* * * * *